US010619170B2

(12) United States Patent
Verwaal et al.

(10) Patent No.: US 10,619,170 B2
(45) Date of Patent: *Apr. 14, 2020

(54) CRISPR-CAS SYSTEM FOR A YEAST HOST CELL

(71) Applicant: DSM IP ASSETS B.V., Heerlen (NL)

(72) Inventors: René Verwaal, Echt (NL); Bernard Meijrink, Echt (NL); Nathalie Wiessenhaan, Echt (NL); Brenda Vonk, Echt (NL); Johannes Andries Roubos, Echt (NL)

(73) Assignee: DSM IP ASSETS B.V., Heerlen (NL)

( * ) Notice: Subject to any disclaimer, the term of this patent is extended or adjusted under 35 U.S.C. 154(b) by 0 days.

This patent is subject to a terminal disclaimer.

(21) Appl. No.: 15/541,431

(22) PCT Filed: Jan. 6, 2016

(86) PCT No.: PCT/EP2016/050136
§ 371 (c)(1),
(2) Date: Jul. 3, 2017

(87) PCT Pub. No.: WO2016/110512
PCT Pub. Date: Jul. 14, 2016

(65) Prior Publication Data
US 2018/0010151 A1  Jan. 11, 2018

(30) Foreign Application Priority Data

Jan. 6, 2015 (EP) .................................... 15150134
Jan. 6, 2015 (EP) .................................... 15150148

(51) Int. Cl.
| | |
|---|---|
| C12P 19/34 | (2006.01) |
| C12N 15/64 | (2006.01) |
| C07H 21/02 | (2006.01) |
| C12N 15/90 | (2006.01) |
| C12N 15/113 | (2010.01) |
| C12N 9/22 | (2006.01) |
| C12N 15/81 | (2006.01) |
| C12N 15/10 | (2006.01) |
| C12P 23/00 | (2006.01) |

(52) U.S. Cl.
CPC ............. *C12N 15/905* (2013.01); *C12N 9/22* (2013.01); *C12N 15/102* (2013.01); *C12N 15/113* (2013.01); *C12N 15/81* (2013.01); *C12N 15/902* (2013.01); *C12P 23/00* (2013.01); *C12N 2310/20* (2017.05)

(58) Field of Classification Search
CPC ........ A61K 38/00; C07K 16/30; C12N 15/10; C12N 15/86; C12N 15/81
See application file for complete search history.

(56) References Cited

U.S. PATENT DOCUMENTS

2018/0023096 A1 * 1/2018 Meijrink ............... C12N 15/63
435/67

FOREIGN PATENT DOCUMENTS

| WO | 2015/004241 A2 | 1/2015 |
| WO | 2015/017866 A1 | 2/2015 |
| WO | 2015/095804 A1 | 6/2015 |

OTHER PUBLICATIONS

Ryan et al., eLife, 2014; 3: 1-15.*
Hoppner (Horm Re. 2002, 58 Suppl. 3:7-15) (Year: 2002).*
Valens et al., Yeast, 1997; 13(4): 379-390 (Year: 1997).*
Wiemann et al., Yeast, 1996; 12: 281-288 (Year: 1996).*
Ryan, Owen W. et al., "Selection of chromosomal DNA libraries using a multiplex CRISPR system", ELIFE, vol. 3, Aug. 19, 2014, XP055175718.
Jacobs, Jake Z. et al., "Implementation of the CRISPR-Cas9 system in fission yeast", Nature Communications, Oct. 29, 2014, vol. 5, p. 5344.
Gao, Yangbin et al., "Self-processing of ribozyme-flanked RNAs into guide RNAs in vitro and in vivo for CRISPR-mediated genome editing", Journal of Integrative Plant Biology, Apr. 6, 2014, vol. 56, No. 4, pp. 343-349.
Bao, Zehua et al., "Homology-Integrated CRISPR-Cas (HI-CRISPR) System for One-Step Multigene Disruption in *Saccharomyces cerevisiae*", ACS Synthetic Biology, Sep. 10, 2014, XP055175736.
Zhang, Guo-Chang et al., "Construction of a Quadruple Auxotrophic Mutant of an Industrial Polyploid *Saccharomyces cerevisiae* Strain by Using RNA-Guided Cas9 Nuclease", Applied and Environmental Microbiology, American Society for Microbiology, US, Oct. 3, 2014, vol. 80, No. 24, pp. 7694-7701.
Ryan, Owen W. et al., "Multiplex Engineering of Industrial Yeast Genomes Using CRISPRm", The Use of CRISPR CAS9, ZFNS, Talens in Generating Site Specific Genome Alterations, Jan. 1, 2014, vol. 546, pp. 473-489.
Xu, Kun et al., "Efficient genome engineering in eukaryotes using Cas9 from *Streptococcus thermophilus*", Cellular and Molecular Life Sciences, Jul. 20, 2014, vol. 72, No. 2, pp. 383-399.
Cencic, Regina et al., "Protospacer Adjacent Motif (PAM)-Distal Sequences Engage CRISPR Cas9 DNA Target Cleavage", PLOS ONE, Oct. 2, 2014, vol. 9, No. 10, p. e109213.
Dicarlo, James E. et al., "Genome engineering in *Saccharomyces cerevisiae* using CRISPR-Cas systems", Nucleic Acids Research, Mar. 4, 2013, vol. 41, No. 7, pp. 4336-4343.
Aleksenko, A. et al., "Autonomous plasmid replication in Aspergillus nidulans: AMA1 and MATE elements", Fungal Genetics and Biology, San Diego, CA, US, Jan. 1, 1997, vol. 21, pp. 373-387.

(Continued)

*Primary Examiner* — Gary B Nickol
*Assistant Examiner* — Lakia J Jackson-Tongue
(74) *Attorney, Agent, or Firm* — McBee Moore & Vanik IP, LLC

(57) ABSTRACT

The present invention relates to the field of molecular biology and cell biology. More specifically, the present invention relates to a CRISPR-CAS system for a yeast host cell.

26 Claims, 35 Drawing Sheets
Specification includes a Sequence Listing.

(56) References Cited

OTHER PUBLICATIONS

Sakuma, Tetsushi et al., "Multiplex genome engineering in human cells using all-in-one CRISPR/Cas9 vector system", Scientific Reports, Jun. 23, 2014, vol. 4.
International Search Report of International Patent Application No. PCT/EP2016/050136 dated Apr. 1, 2016.

* cited by examiner

ADE2.Y guide-RNA

```
5' CTAGCTGAAAAATGTGATGTGCTAACGATTGAGATGAGCATGTTGATGTTCCTACACTAAAGAATCTTCAAGTAAAACATCCCAAATTAAAAATTTACCCTTCTCCA 3'  Genomic DNA sequence
3' GATCGACTTTTTACACTACGATTGCACGATTGCTAACTCTACTCGTAACTGTGACAACTGTCATTCTTAGAAGTTCATTTGTAGGGTTTAATTTTAAAATGGGAAGAGGT 5'
5' CTAGCTaAAAATGTGATGTGCTAACGATTGAGATGAGCATGTTGATGTTCaTACACTAAAGAATCTTCAAGTAAAACATCCCAAATTAAAAATTTACCCTCTCCA 3'  DS oligonucleotide
3' GATCGaaTTTTTACACTACGATTGCTAACTCGTAACTCGTAACTCTACTCGATTGAGATGAGCATGTACAACTACAAGTATGTGATTTCTTAGAAGTTCATTTGTAGGGTTTAATTTTTAAATGGGAAGAGGT 5'  sequence Introduce stop codon (G to T mutation) and PAM mutation
```

*Fig. 7*

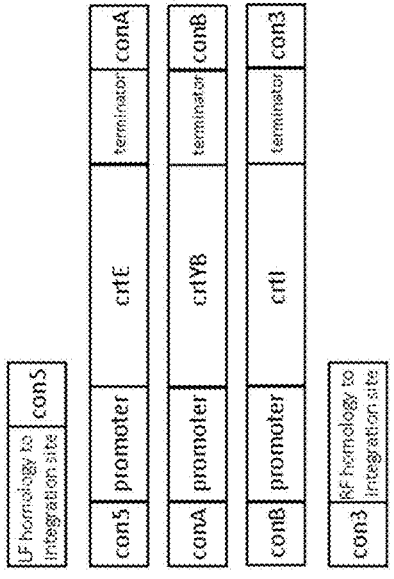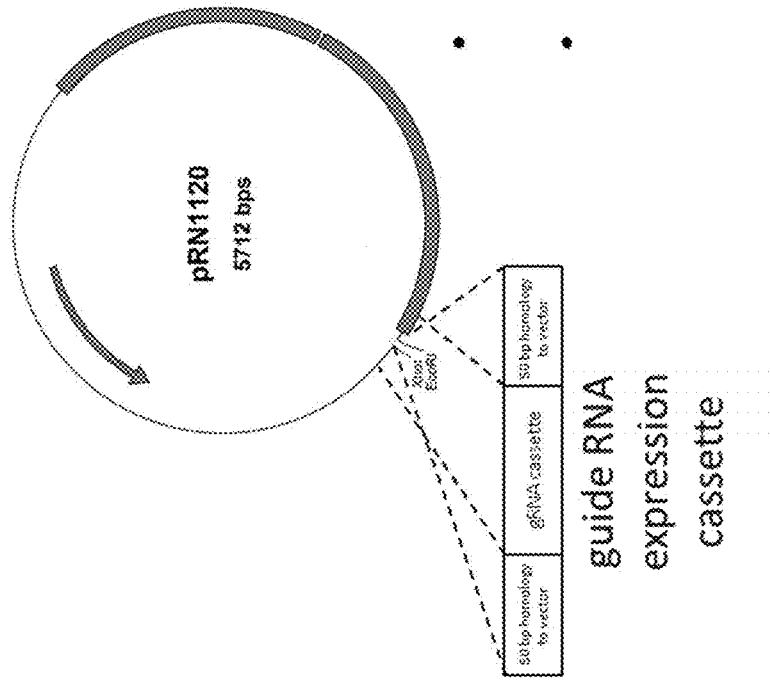
Fig. 29

CRISPR-CAS SYSTEM FOR A YEAST HOST CELL

CROSS-REFERENCE TO RELATED APPLICATIONS

This application is a National Stage entry of International Application No. PCT/EP2016/050136, filed Jan. 6, 2016, which claims priority to European Patent Application No. 15150134.3, filed Jan. 6, 2016, European Patent Application No. 15150148.3, filed Jan. 6, 2016, and U.S. Provisional Application No. 62/177,497, filed Mar. 16, 2015. The disclosures of the priority applications are incorporated in their entirety herein by reference.

REFERENCE TO SEQUENCE LISTING SUBMITTED AS A COMPLIANT ASCII TEXT FILE (.TXT)

Pursuant to the EFS-Web legal framework and 37 CFR §§ 1.821-825 (see MPEP § 2442.03(a)), a Sequence Listing in the form of an ASCII-compliant text file (entitled "Sequence_Listing_2919208-313001_ST25.txt" created on 14 Jun. 2017, and 29,833,085 bytes in size) is submitted concurrently with the instant application, and the entire contents of the Sequence Listing are incorporated herein by reference.

FIELD OF THE INVENTION

The present invention relates to the field of molecular biology and cell biology. More specifically, the present invention relates to a CRISPR-CAS system for a yeast host cell.

BACKGROUND TO THE INVENTION

Recent advances in genomics techniques and analysis methods have significantly accelerated the ability to e.g. catalog and map genetic factors associated with a diverse range of biological functions and diseases. Precise genome engineering technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors nucleases (TALENs), or homing meganucleases are available for producing targeted genome perturbations, there remains a need for new genome engineering technologies that are affordable, easy to set up, scalable, and amenable to targeting multiple positions within a genome. The engineering of meganucleases has been challenging for most academic researchers because the DNA recognition and cleavage functions of these enzymes are intertwined in a single domain. Robust construction of engineered zinc finger arrays has also proven to be difficult for many laboratories because of the need to account for context-dependent effects between individual finger domains in an array. There thus exists a pressing need for alternative and robust techniques for targeting of specific sequences within a host cell with a wide array of applications.

SUMMARY OF THE INVENTION

The present invention addresses above described need and provides such technique. The present invention is based on the CRISPR-Cas system, which does not require the generation of customized proteins to target-specific sequences but rather a single Cas enzyme that can be programmed by a guide-polynucleotide to recognize a specific polynucleotide target; in other words, the Cas enzyme can be recruited to a specific polynucleotide target using said guide-polynucleotide molecule. Adding the CRISPR-Cas system to the repertoire of genomics techniques and analysis methods may significantly simplify existing methodologies in the field of molecular biology.

The present invention provides a non-naturally occurring or engineered composition comprising a source of a CRISPR-Cas system comprising a guide-polynucleotide and a Cas protein, wherein the guide-polynucleotide comprises a sequence that essentially is the reverse complement of a target-polynucleotide in a host cell and the guide-polynucleotide can direct binding of the Cas protein at the target-polynucleotide in the host cell to form a CRISPR-Cas complex.

The present invention further relates to a method of modulating expression of a polynucleotide in a cell, comprising contacting a host cell with the composition according to the present invention, wherein the guide-polynucleotide directs binding of the Cas protein at the target-polynucleotide in the host cell to form a CRISPR-Cas complex.

The present invention further relates to a host cell comprising a composition according to the present invention.

The present invention further relates to a method of producing a host cell, comprising contacting a host cell with the composition according to the present invention, wherein the guide-polynucleotide directs binding of the Cas protein at the target-polynucleotide in the host cell to form a CRISPR-Cas complex.

The present invention further relates to a method for the production of a compound of interest, comprising culturing under conditions conducive to the compound of interest a host cell according to the present invention and optionally purifying or isolating the compound of interest.

BRIEF DESCRIPTION OF THE DRAWINGS

FIG. 7 depicts the introduction of the ade2-101 mutation into the genomic DNA (SEQ ID NO: 23) of strain CEN.PK 113-7D by transformation of one of the all-in-one vectors pSCN030 to pSCN035 together with the double strand (DS)

oligonucleotide sequence (SEQ ID NOs: 16 and 17). The genomic target sequence present in the genomic DNA SEQ ID NO: 23) is underlined. The G to T mutation is present on the DS oligo (indicated in bold; SEQ ID NOs: 16 and 17). A silent mutation of the PAM (C to A mutation, indicated in bold) is present on the DS oligo, in order to prevent the gRNA to target the CAS9 protein to the DS oligo and to prevent cleavage of the DS oligo. After correct integration of the DS oligo into the genomic DNA, G at nucleotide position 190 is mutated to T (introduction of stop codon) and C at position 236 is mutated to A (mutation of PAM sequence).

Figure 8:
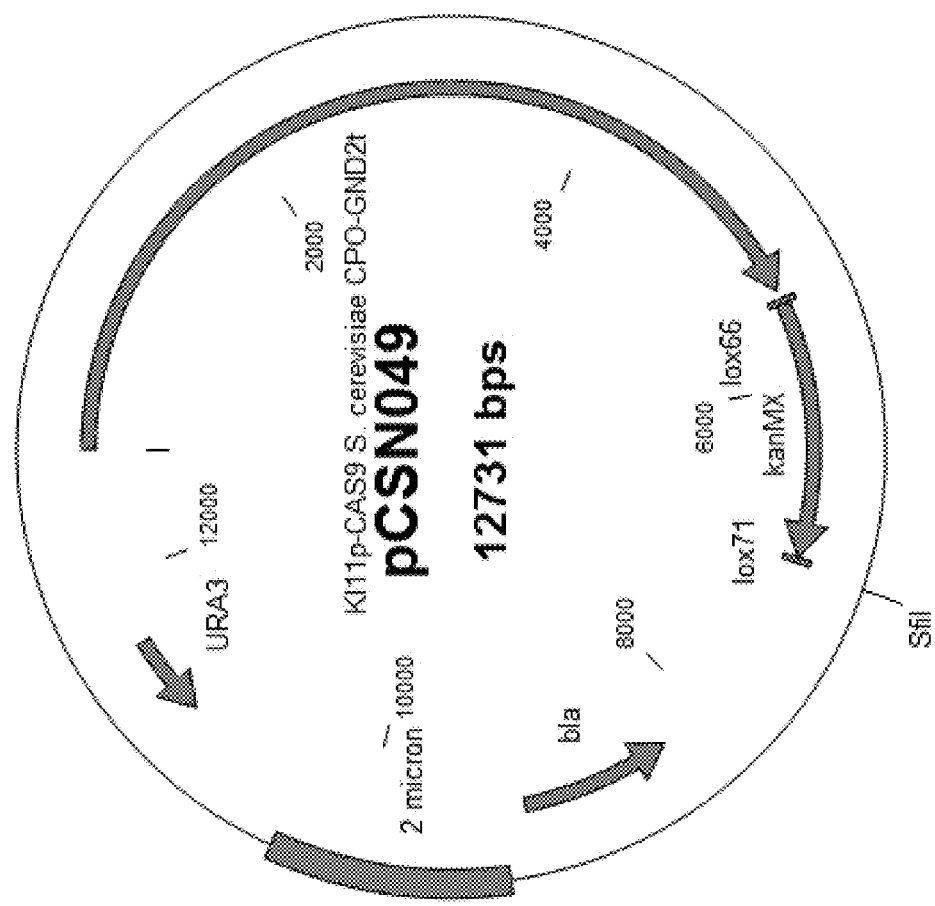

FIG. 8 depicts a vector map of pCSN049 expressing CAS9 human CO (SEQ ID NO: 9), a KanMX marker is present on the vector.

Figure 9:
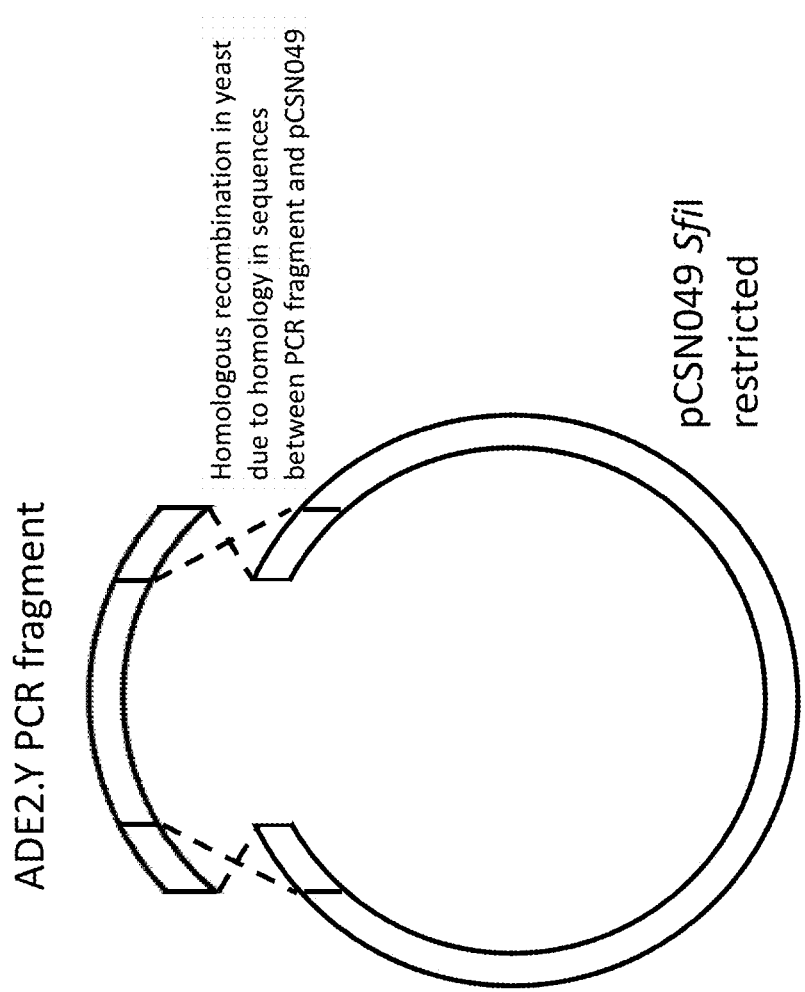

FIG. 9 depicts a graphical representation of in vivo recombination of the ADE2.Y PCR fragment into plasmid pCSN049.

Figure 10:
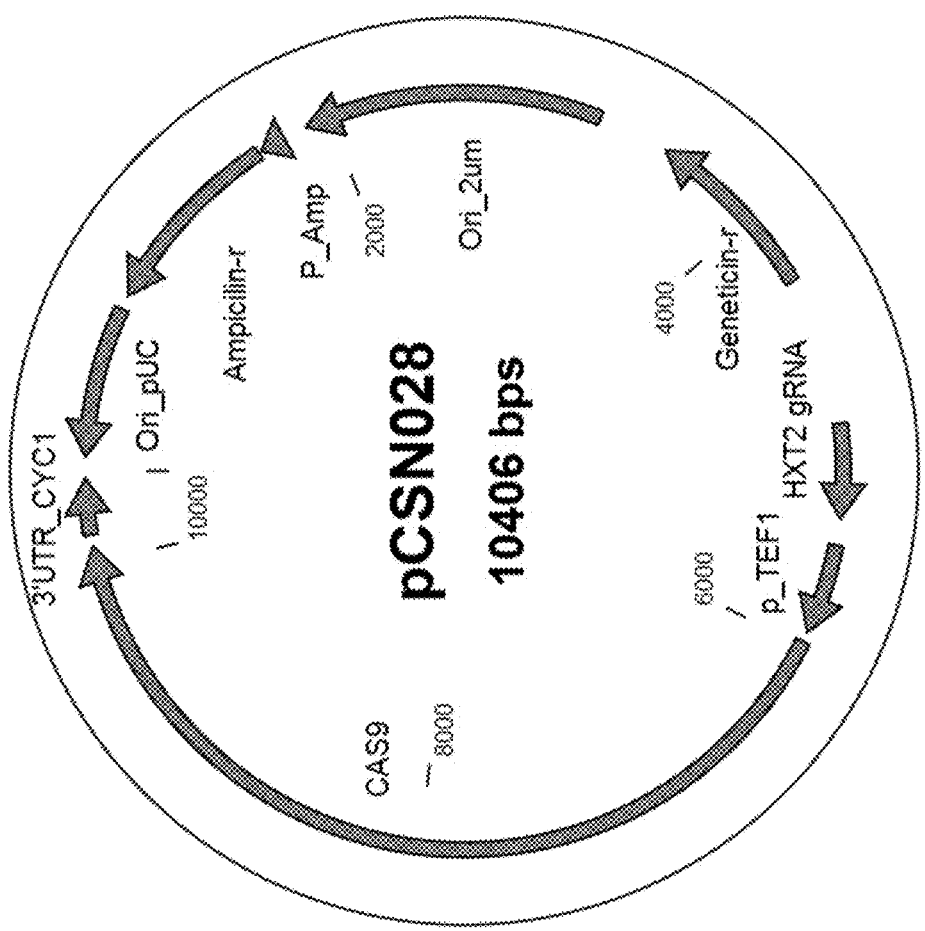

FIG. 10 depicts a vector map of pCSN028 expressing CAS9 and HXT2 guide-RNA, a selection marker to confer resistance against G418 and an ampicillin resistance marker are present on the all-in-one vector. The sequence of this vector is set out in SEQ ID NO: 24.

Figure 11:

FIG. 11 depicts the introduction of the N361T mutation into the Hxt2 protein. All-in-one vectors pSCN028 to pSCN035 were transformed into S. cerevisiae together with the double strand (DS) oligonucleotide sequence (SEQ ID NOs: 26 and 27). The genomic target sequence present in the genomic DNA (SEQ ID NO: 25) is underlined. The A1082C and C1083A mutations to be introduced into genomic DNA are present on the DS oligo (SEQ ID NOs: 26 and 27) indicated in bold and in lower case). A silent mutation of the PAM C1104A, indicated in bold and in lower case is present on the DS oligo, in order to prevent the gRNA to target the CAS9 protein to the DS oligo and to prevent cleavage of the DS oligo. After correct integration of the DS oligo into the genomic DNA, the mutated HXT2 gene encodes a Threonine (T) instead of an Asparagine (N) on amino acid position 361 and in addition a silent mutation of PAM sequence is introduced (C1104A).

Figure 12:
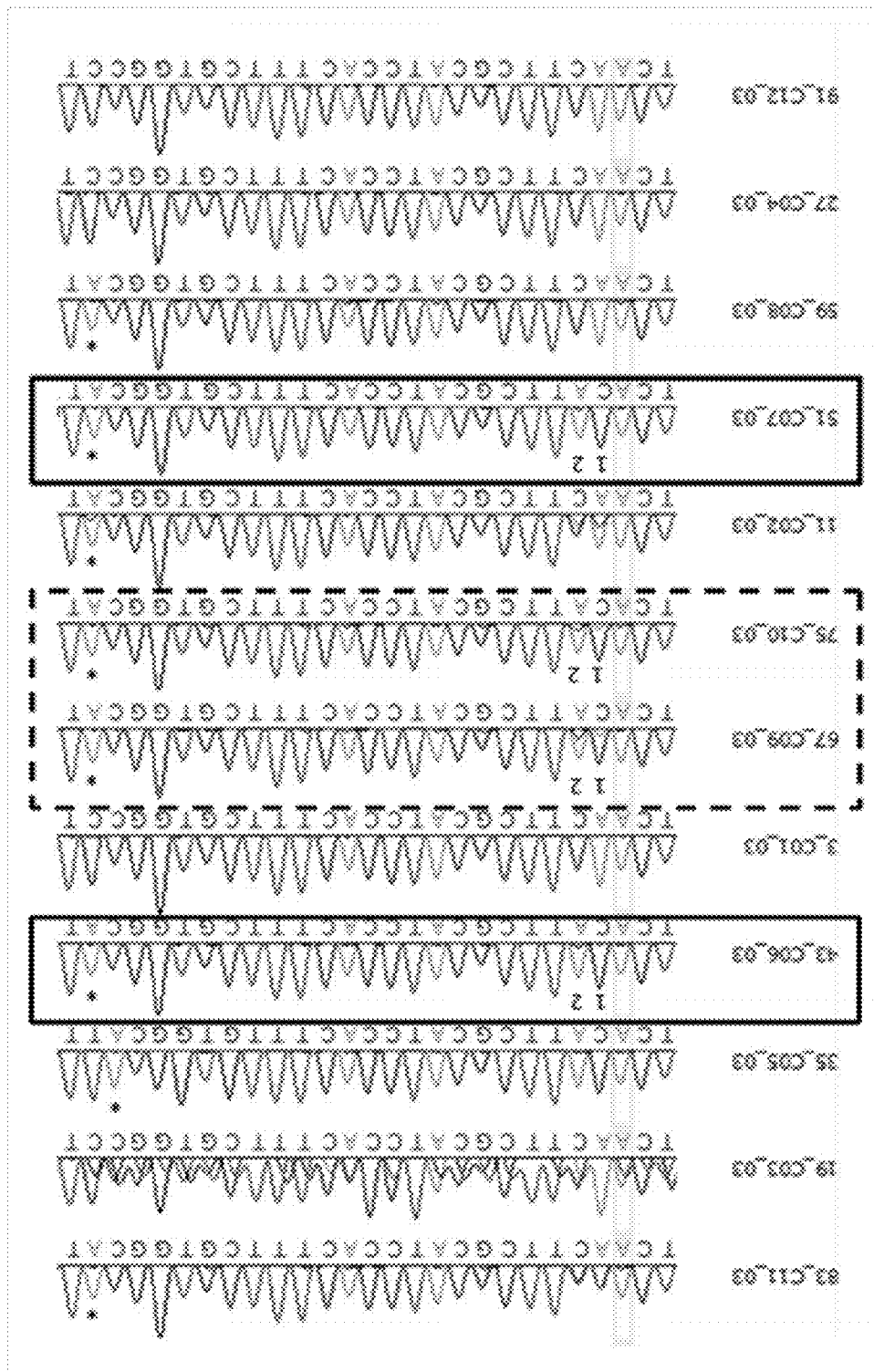

FIG. 12 depicts an example of sequence read results demonstrating introduction of the A1082C (1) SEQ ID NOs: 26 and 27) and C1083A (2) (SEQ ID NOs: 26 and 27) mutations in one or both alleles of the HXT2 gene (SEQ ID NO: 25) in the diploid S. cerevisiae strain CEN.PK2. The dashed line boxed results indicate the situation in which one allele is mutated. The solid line boxed results indicate the situation in which two alleles are mutated. Mutation of the PAM (C1104A) is indicated by an asterisk.

Figure 13:
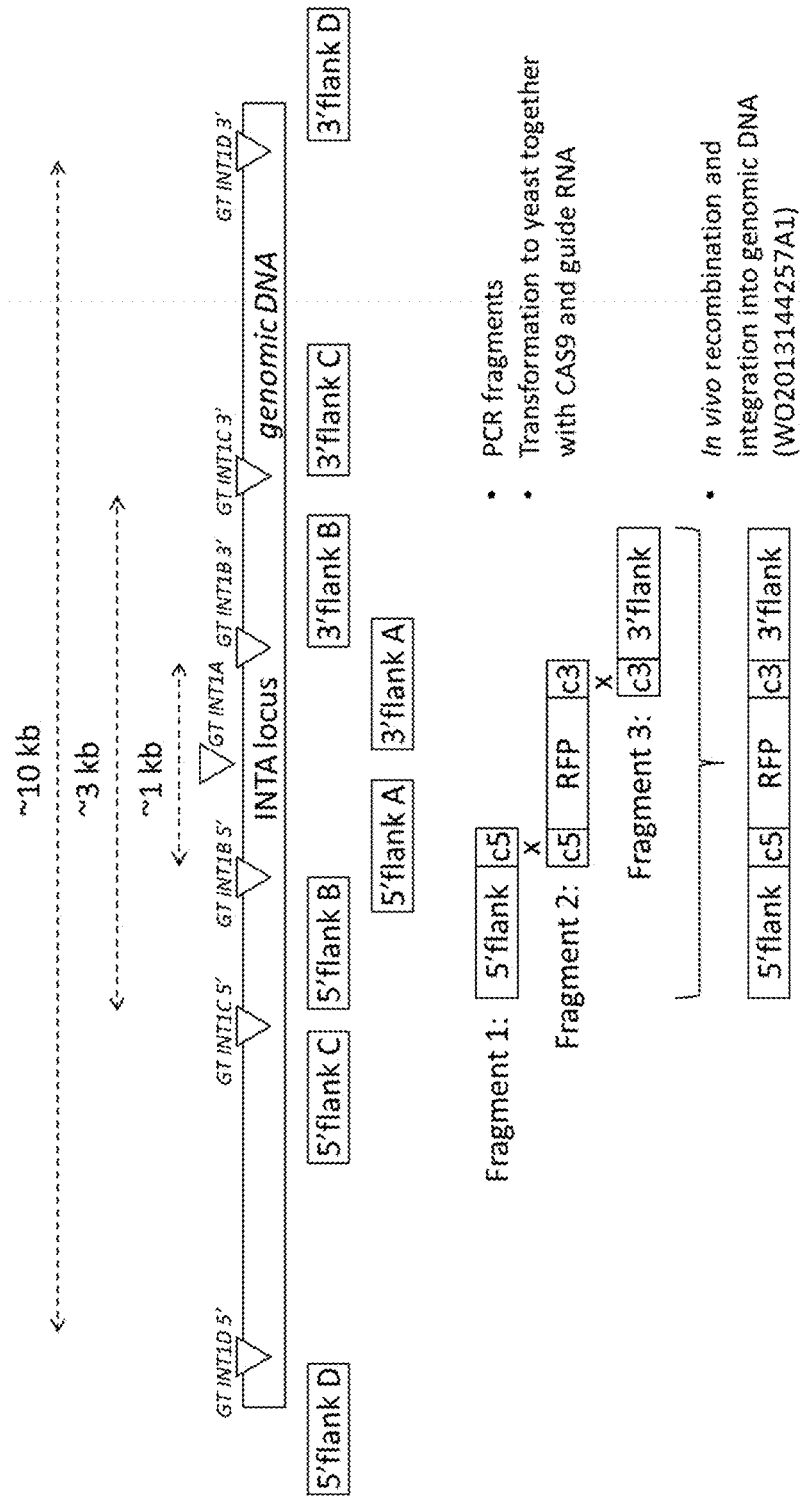

FIG. 13 depicts a graphical representation of the strategy for deletion of up to 10 kb of genomic DNA around the INT1A locus.

Figure 14:
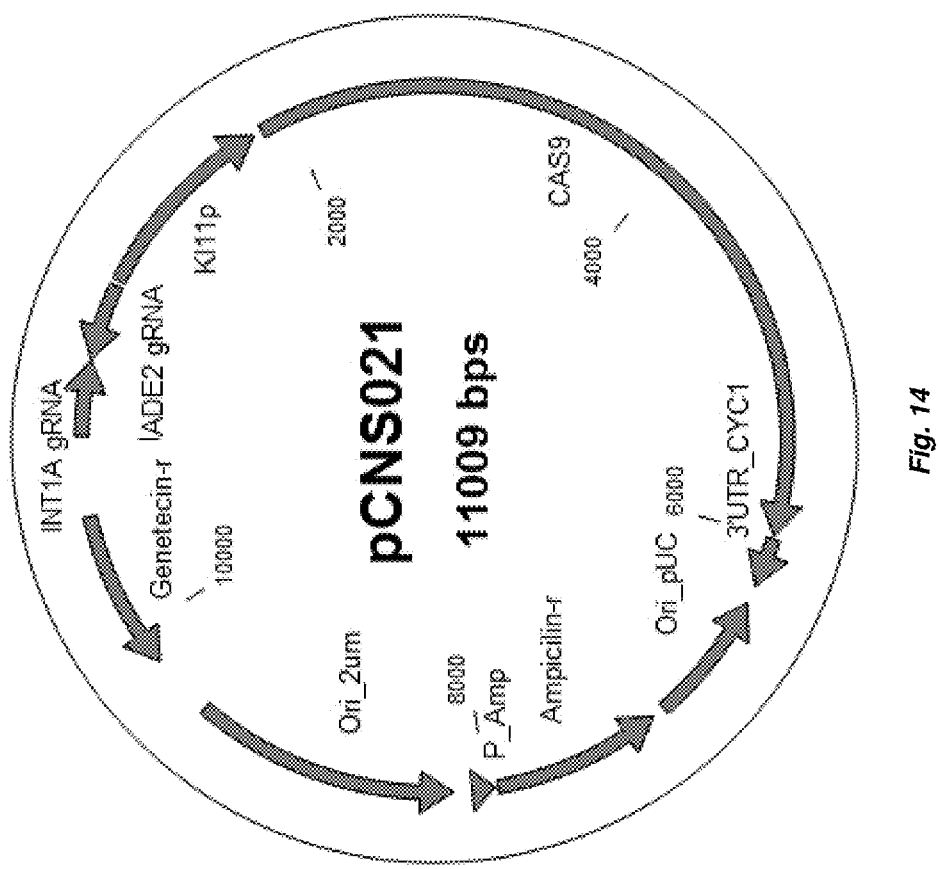

FIG. 14 depicts a vector map of pCSN021 expressing CAS9 and two guide-RNA sequences being INT1A (SEQ ID NO:65) and ADE2 (which is ADE2.Y as shown in SEQ ID NO:58). The two guide-RNA sequences are positioned in opposite orientations. A selection marker to confer resistance against G418 and an ampicillin resistance marker are present on the all-in-one vector. The sequence of vector pCSN021 is set out in SEQ ID NO: 50.

Figure 15:
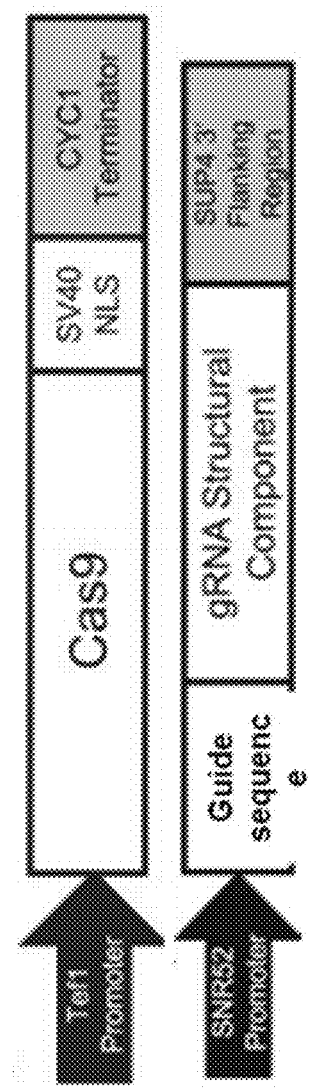

FIG. 15 depicts design of the Cas9 and gRNA constructs. As an example, the Cas9 expression cassette contains a SV40 nuclear localization signal fused to Cas9, and expression is controlled by a TEF1 constitutive promoter and CYC1 terminator. The gRNA is expressed under the snoRNA SNR52 promoter and contained a terminator from the 3' region of the yeast SUP4 gene. This figure is adapted from DiCarlo et al., 2013.

Figure 16:
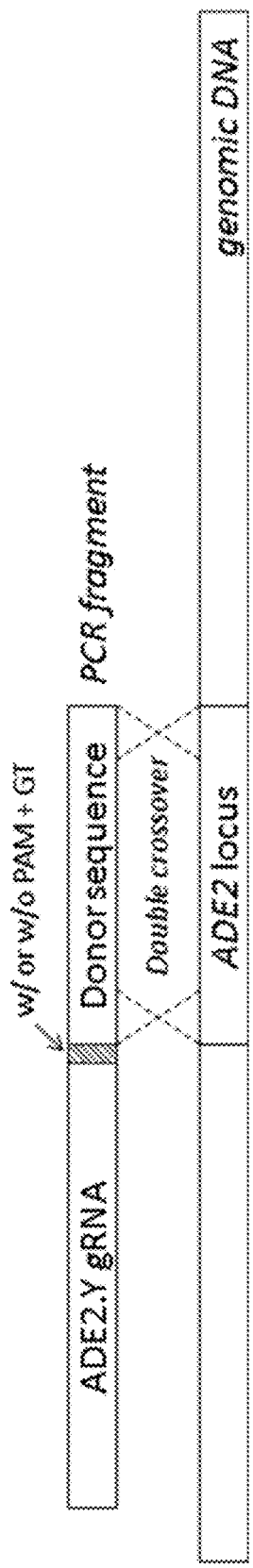

FIG. 16 depicts a schematic representation for introduction of mutations in the ADE2 locus. Together with plasmid pCSN049 (expressing CAS9), the ADE2.Y guide-RNA is transformed as PCR fragment fused to the donor DNA. The ADE2.Y guide-RNA sequence may be directly fused to the donor DNA or it can be separated by a PAM sequence and the 20 bp ADE2.Y guide-sequence. The donor DNA that integrates into the ADE2 locus in order to introduce the desired point mutations (G to T mutation at nucleotide position 190, and an additional C to A mutation at position 236) integrates into the genomic DNA by double cross over.

Figure 17:
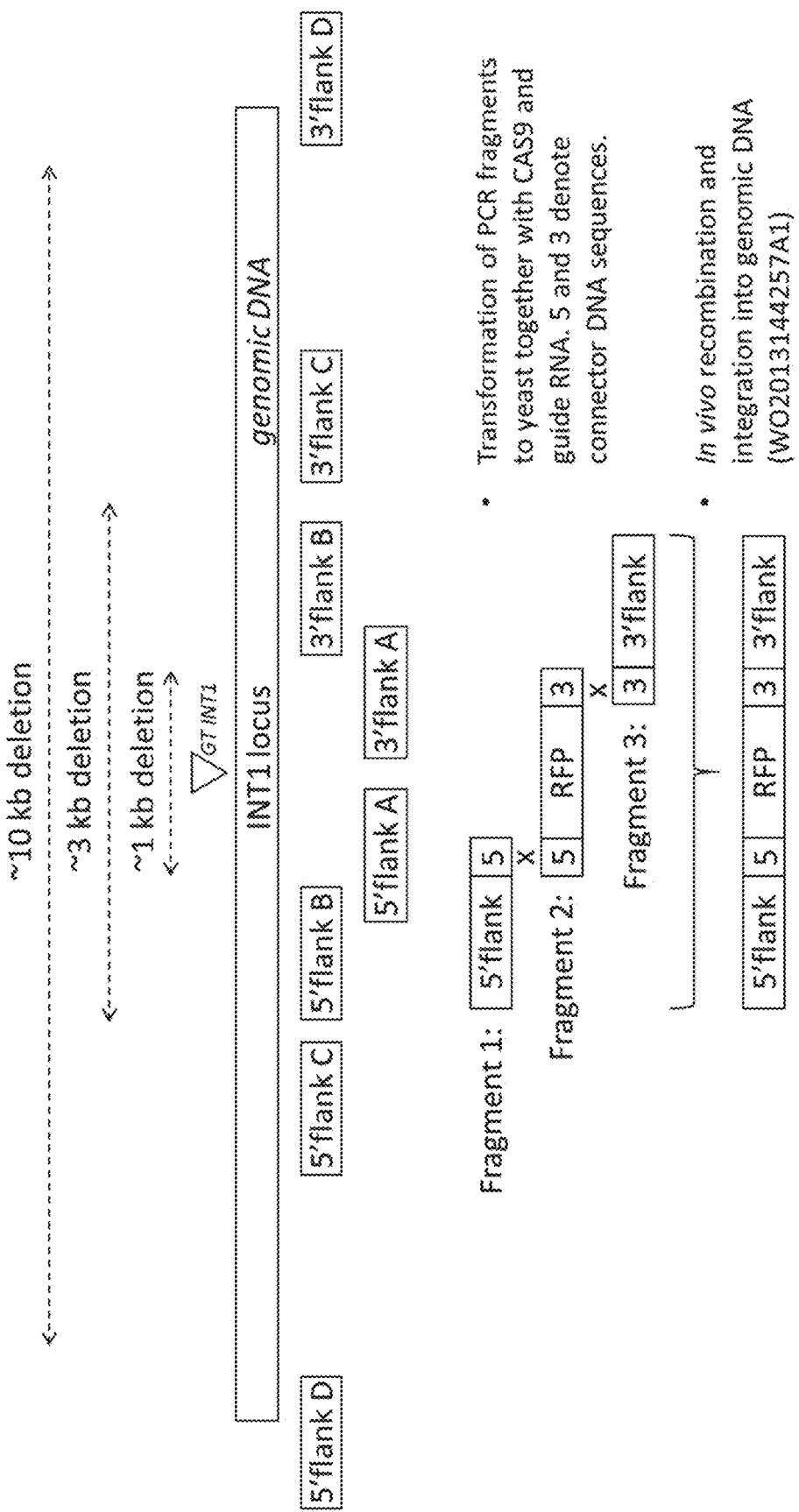

FIG. 17 depicts a graphical representation of the strategy for deletion of up to 10 kb of genomic DNA around the INT1 locus. Using this approach, one guide RNA was targeted to the INT1 locus where CAS9 made a double stranded break in the genomic DNA of the cell. The donor DNA consisted of 3 PCR fragments: 1) 5' flank sequence-connector 5 sequence. 2) connector 5 sequence-promoter-red fluorescent protein (RFP) ORF-terminator-terminator-connector 3 sequence. 3) connector 3 sequence-3' flank sequence. The presence of the connector sequences allow in vivo recombination and integration of the three PCR products into genomic DNA (WO2013144257A1), where the flank sequences enable repair of the double strand break. As explained in the example, by choosing different positions of the flank sequences (approximately 500 bp, approximately 1500 bp or approximately 5000 positioned at the 5' or 3' end of the INT1 integration site), respectively 1 kb, 3 kb or 10 kb deletion of genomic DNA was achieved. By choosing the positions of the flank sequence immediately at the 5' or 3' end of the INT1 integration site, integration of the RFP expression cassette at the INT1 integration site was achieved.

Figure 18:
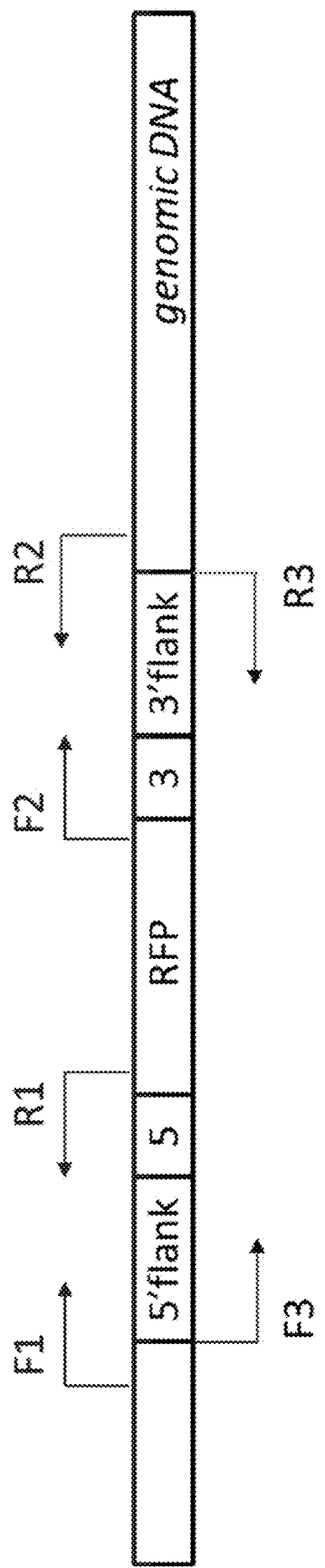

FIG. 18 depicts the design of the primers for the PCR to confirm the integration of RFP in to the genome and deletion of up to 10 kb genomic DNA surrounding the INT1 locus.

Figure 19:
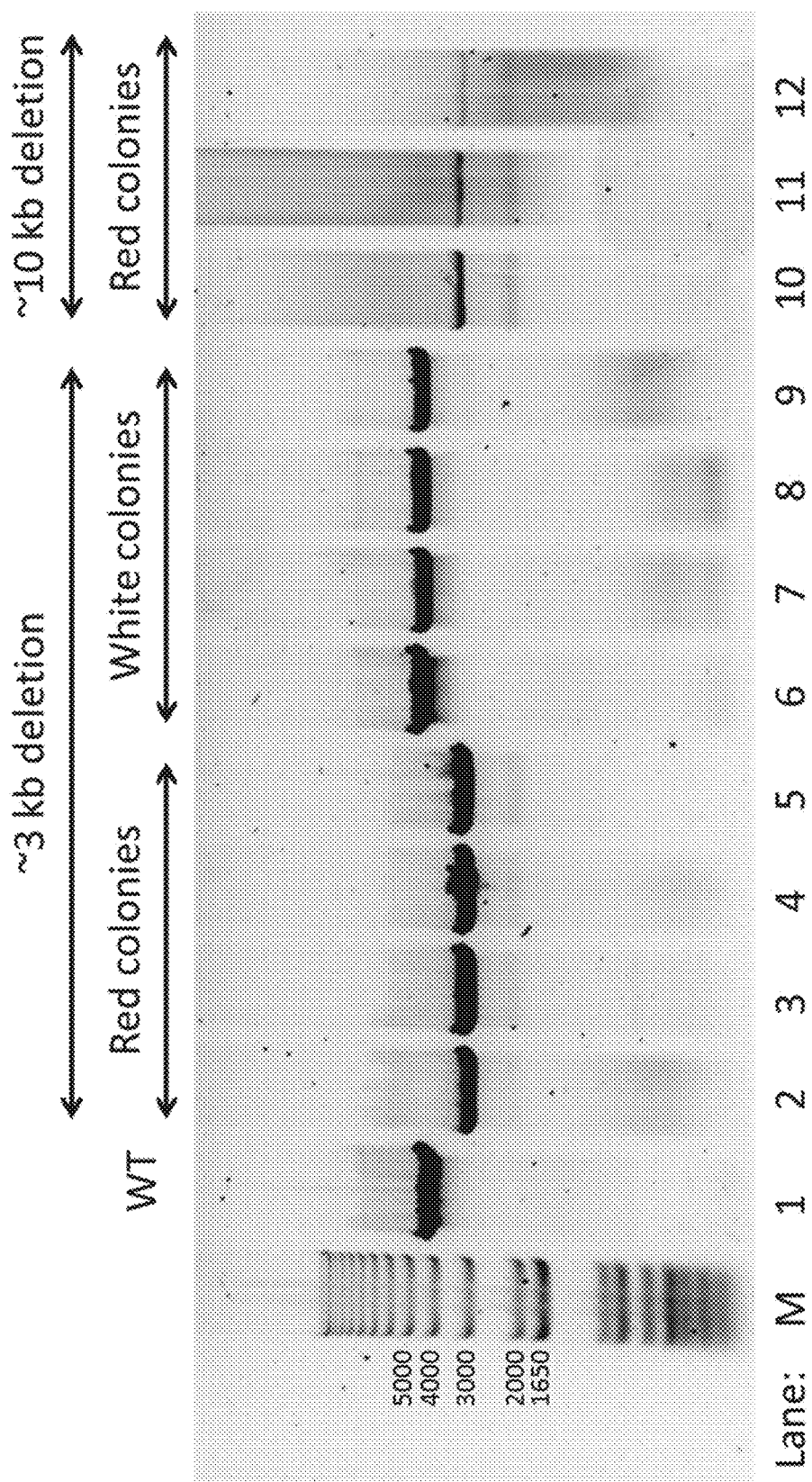

FIG. 19 depicts the results of the PCR experiment confirming deletion of 3 kb and 10 kb genomic DNA and integration of RFP at the INT1 locus.

Figure 20:
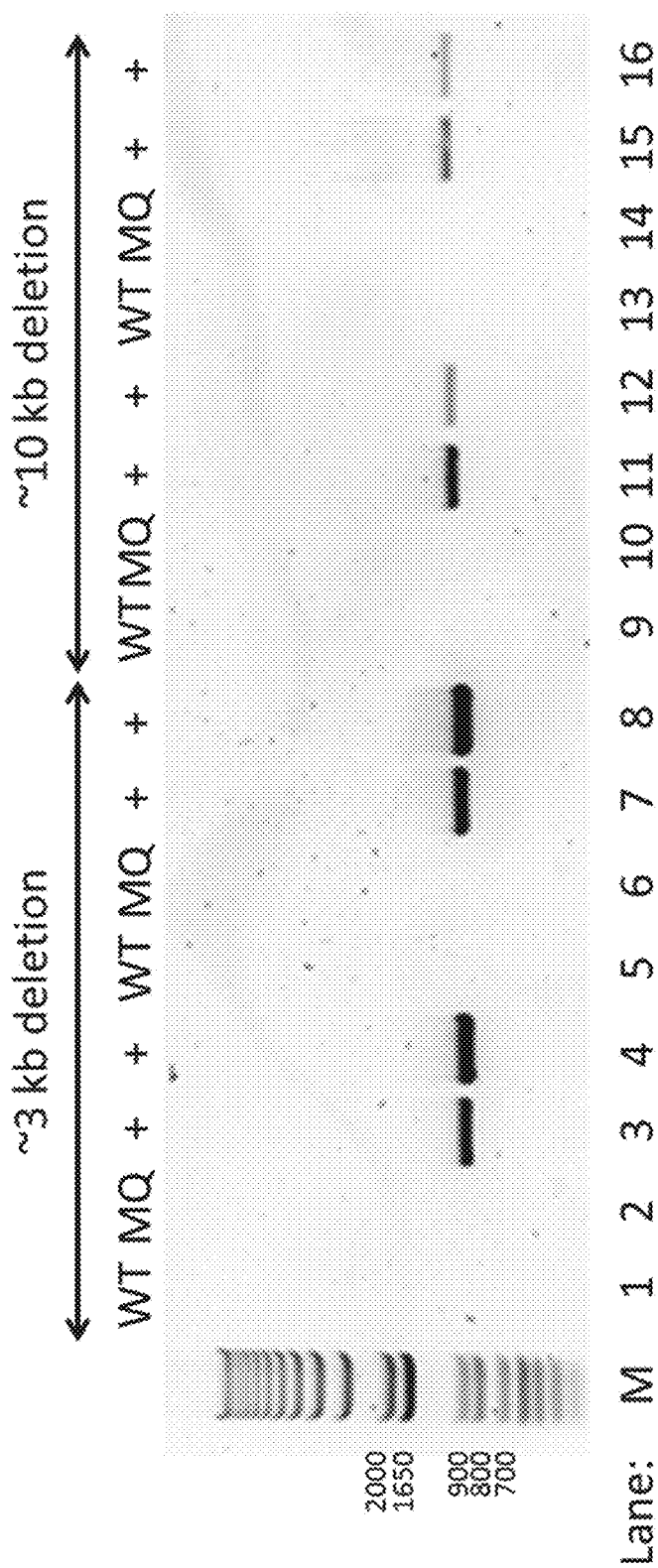

FIG. 20 depicts the results of the PCR experiments to confirm the correct integration of the RFP expression cassettes at the desired loci to obtain 3 or 10 kb deletion of genomic DNA at the INT1 locus. WT (genomic DNA isolated from strain CEN.PK113-7D) and MQ (milliQ) represent negative controls in the PCR reactions. The + denotes a red colored transformant in which deletion of the 3 kb or 10 kb fragment of genomic DNA was confirmed (results shown in FIG. 19).

Figure 21:
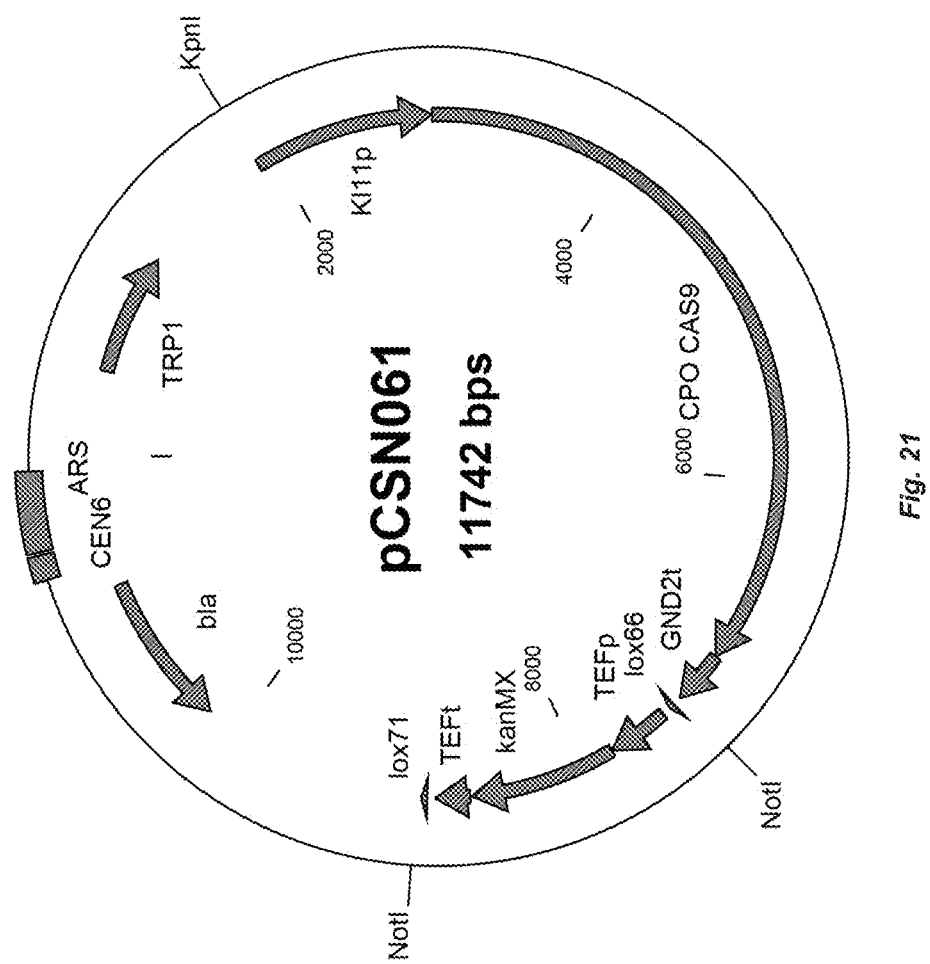

FIG. 21 depicts the vector map of single copy (CEN/ARS) vector pCSN061 expressing CAS9 codon pair optimized for expression in S. cerevisiae (SEQ ID NO: 11). A KanMX marker is present on the vector.

Figure 22:
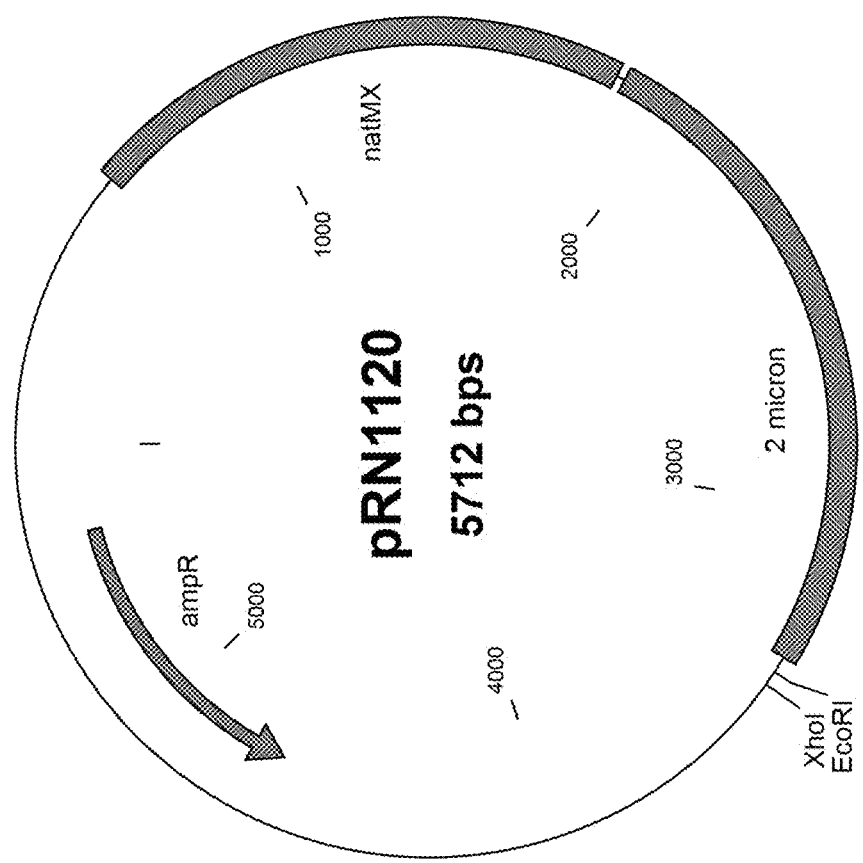

FIG. 22 depicts the vector map of multicopy (2 micron) vector pRN1120. A NatMX marker is present on the vector.

Figure 23:
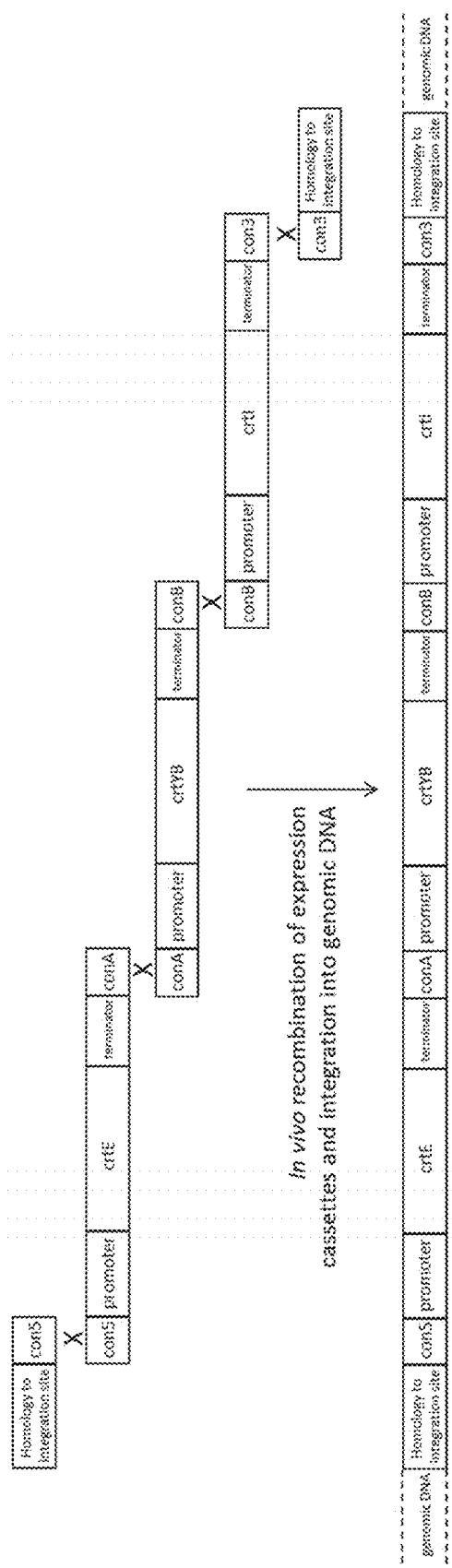

FIG. 23 depicts the donor DNA singleplex approach; representation of transformed DNA sequences and integration into genomic DNA by in vivo recombination in yeast using connector sequences and overlap with genomic DNA. The singleplex transformation approach is further depicted in FIG. 24.

Figure 24:
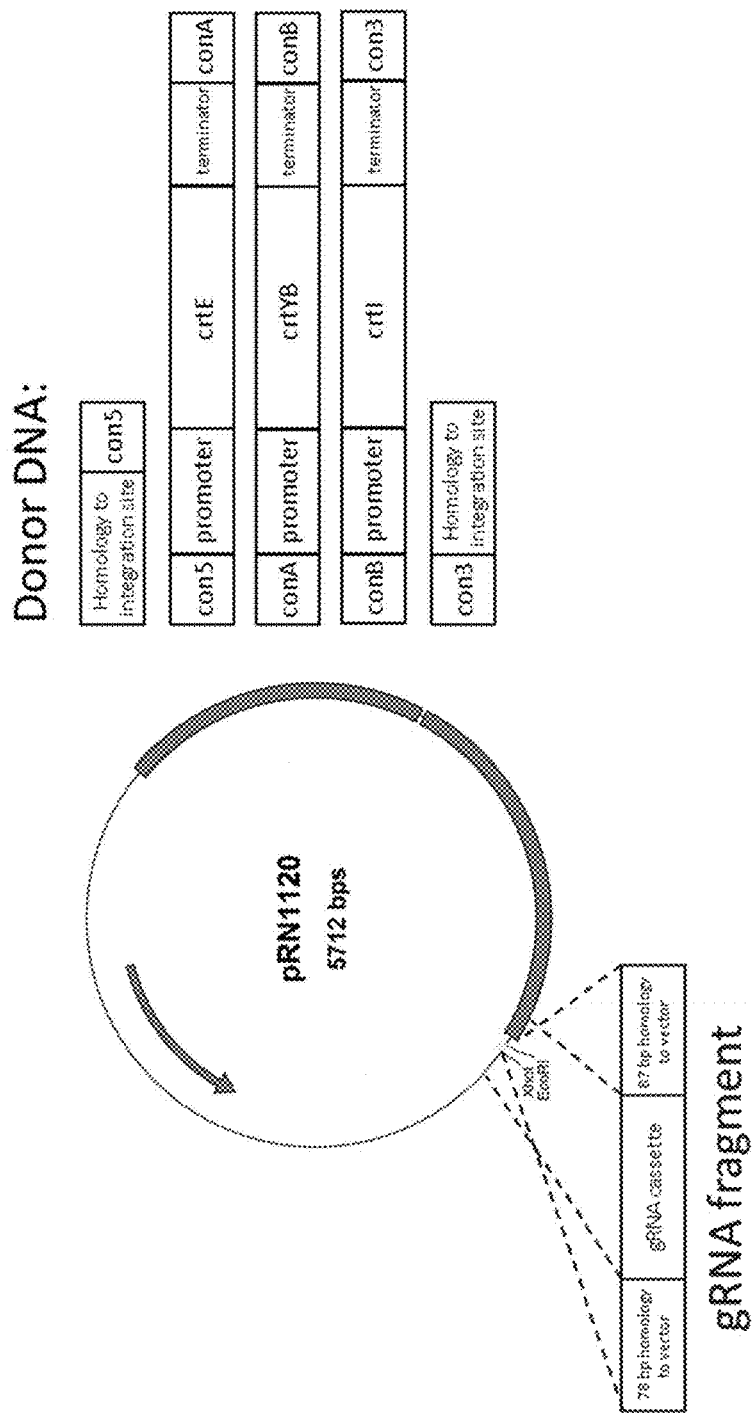

FIG. 24 depicts the singleplex transformation approach. Step 1: Transform cells with pSCN061 (CAS9 plasmid). Step 2: Transform cells pre-expressing CAS9 with pRN1120 digested with XhoI, EcoRI, guide RNA and donor DNA.

Figure 25:
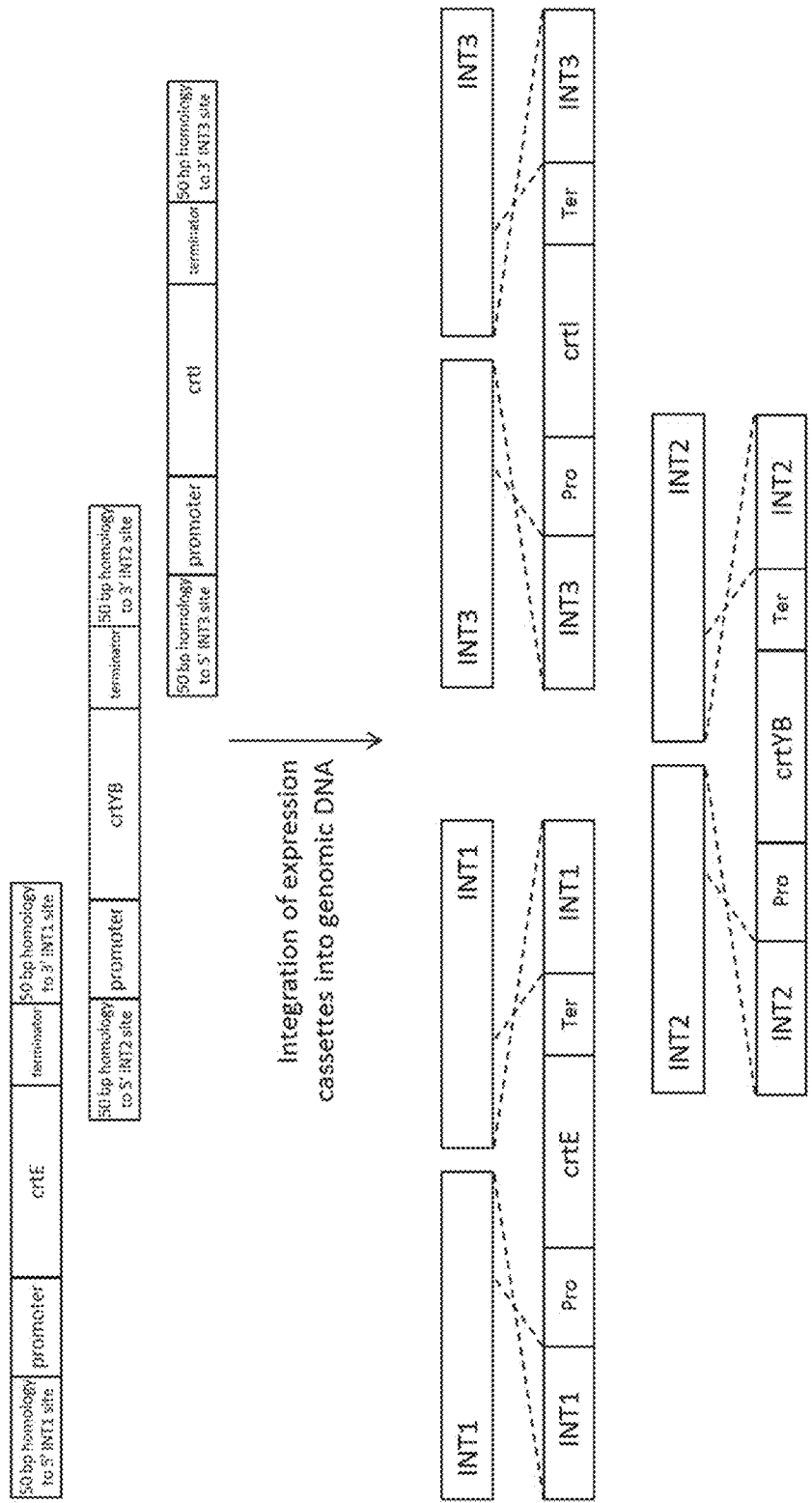

FIG. 25 depicts a schematic representation of the donor DNA sequences used in the multiplex approach. The donor DNA sequences (carotenoid gene expression cassettes) contain approximately 50 bp flanks sequences (INT 5' and INT 3'), that have homology with the intended integration sites (INT1, INT2 or INT3). Upon transformation, the donor DNA sequences integrate into genomic intended integration sites. The multiplex transformation approach is further depicted in FIG. 26.

Figure 26:
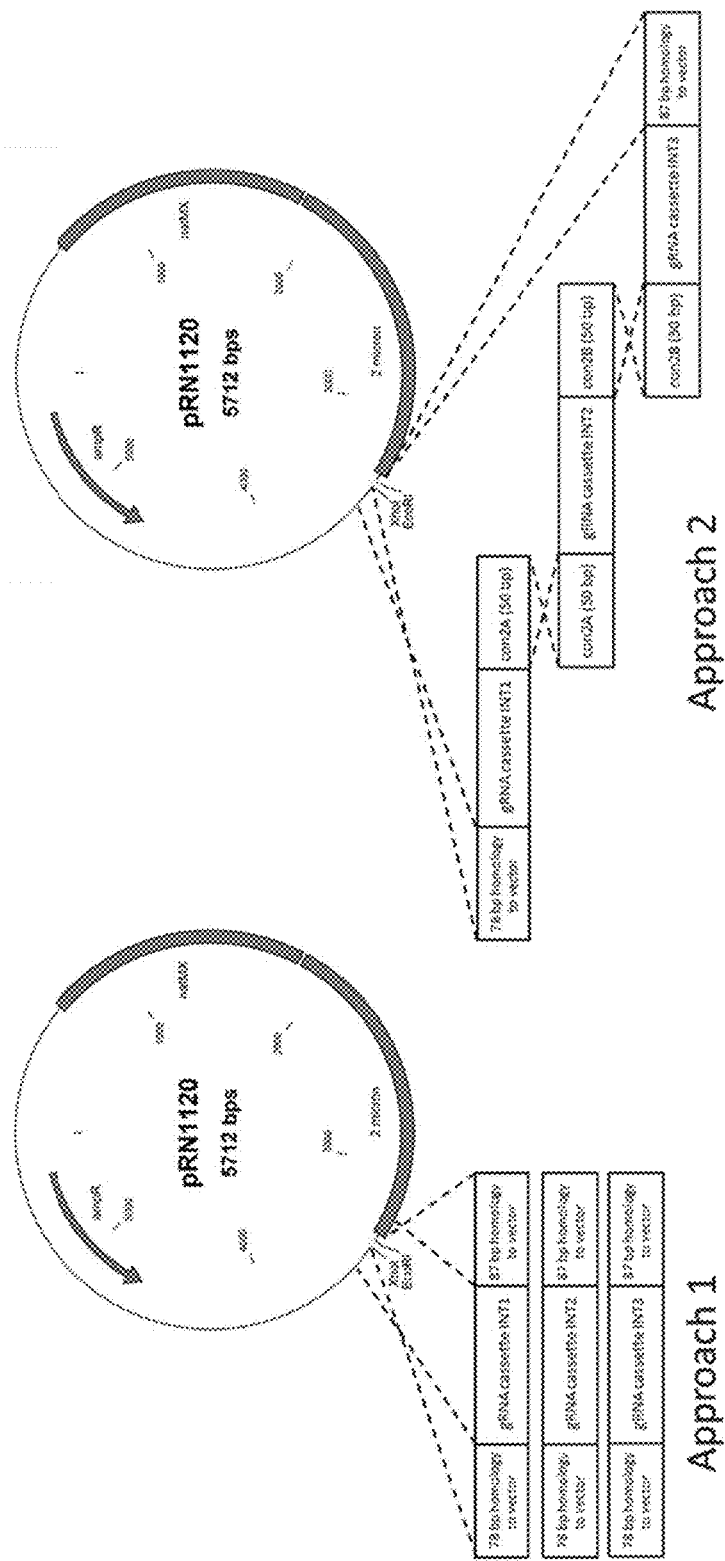

FIG. 26 depicts multiplex transformation approaches 1 and 2 using approximately 50 bp flanks with homology to genomic DNA present in donor DNA sequences. In approach 1, each of the guide RNA expression cassettes contain overlapping sequences with the linearized vector pRN1120, enabling each of the guide RNA expression cassettes to recombine into the linearized vector. In approach 2, the first and third guide RNA expression cassettes contain overlapping sequences with the linearized vector pRN1120, and the second guide RNA expression cassette contains overlapping sequences with the first and second guide RNA expression cassettes. As such, the three guide RNA expression cassettes sequences are recombined into the vector pRN1120 as one stretch of DNA, as depicted.

Figure 27:
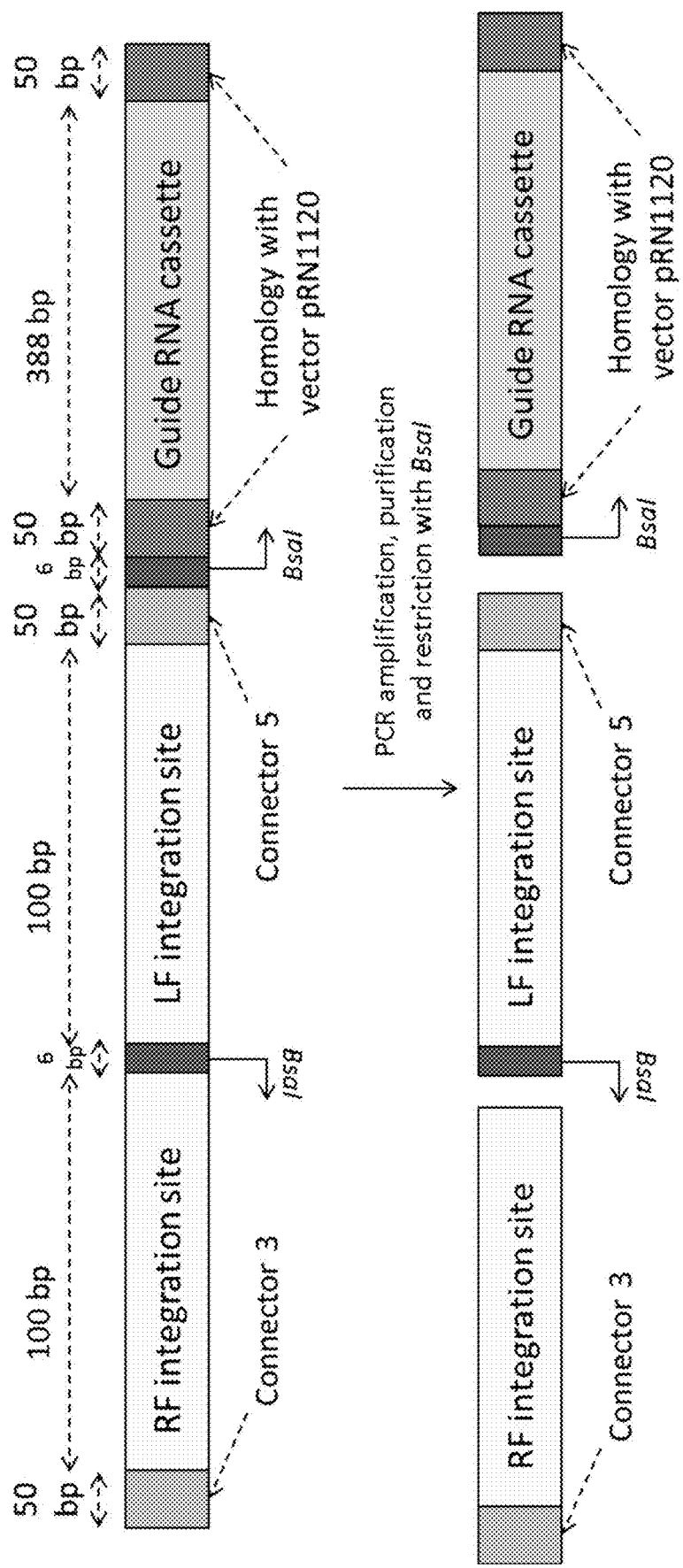

FIG. 27 depicts the details of flank_DNA-gRNA gBlock_1 and the strategy to obtain the left flank and right integration flanks and a guide RNA cassette after restriction of the flank_DNA-gRNA PCR fragment with BsaI.

Figure 28:
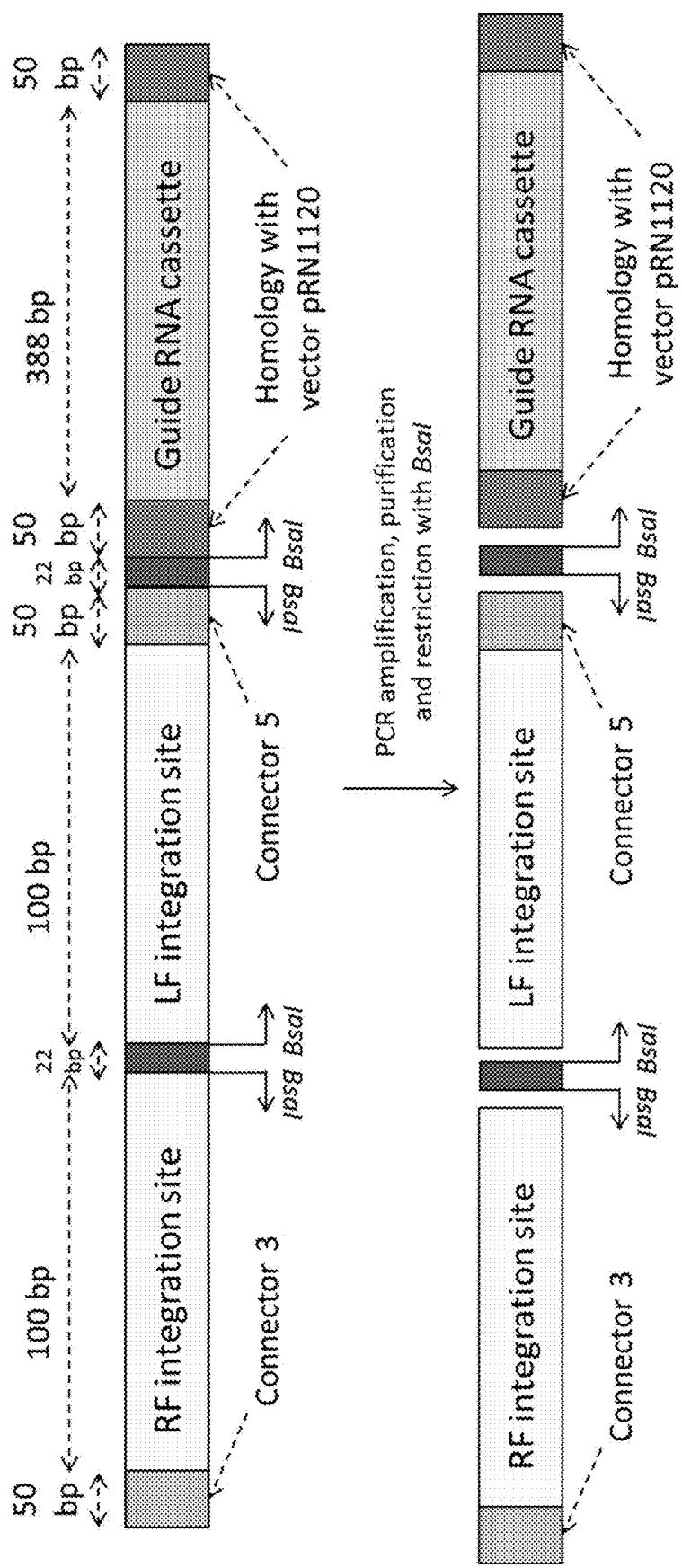

FIG. 28 depicts the details of flank_DNA-gRNA gBlock_2 and the strategy to obtain the left flank and right integration flanks and a guide RNA cassette after restriction of the flank_DNA-gRNA PCR fragment with BsaI.

FIG. 29 depicts the singleplex transformation approach using a guide RNA expression cassette containing 50 bp homology at the 5' and 3' end of the nucleotide sequence with linearized vector pRN1120. Step 1: Transform cells with pSCN061 (CAS9 plasmid). Step 2: Transform cells pre-expressing CAS9 with pRN1120 digested with XhoI, EcoRI, guide RNA and donor DNA. The right flank, left flank and guide RNA expression cassette originate from a gBlock as depicted in FIG. 27 and FIG. 28. Integration of the donor DNA into genomic DNA is depicted in FIG. 23.

Figure 30:
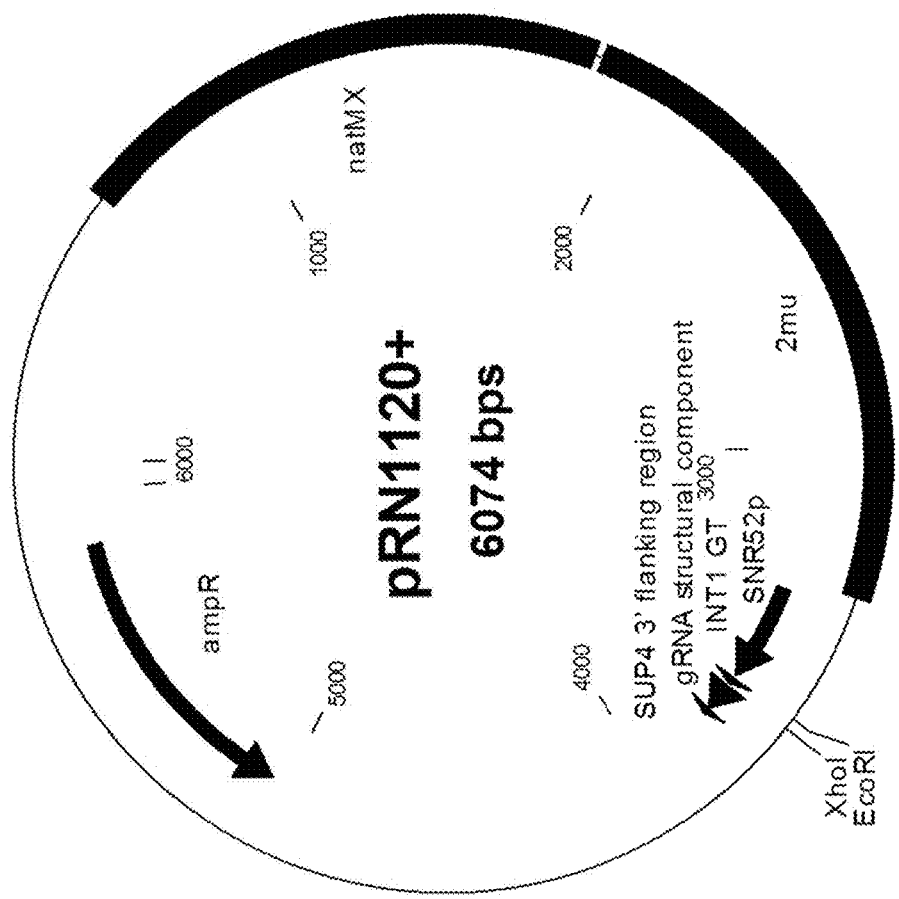

FIG. 30 depicts the vector map of multi-copy (2 micron) vector pRN1120+. The vector contains the SNR52p RNA polymerase III promoter, the 20 nucleotide INT1 genome target (INT1 GT) flanked by EcoRI and XhoI restriction enzyme sequences, the gRNA structural component and the SUP4 3' flanking region.

Figure 31:
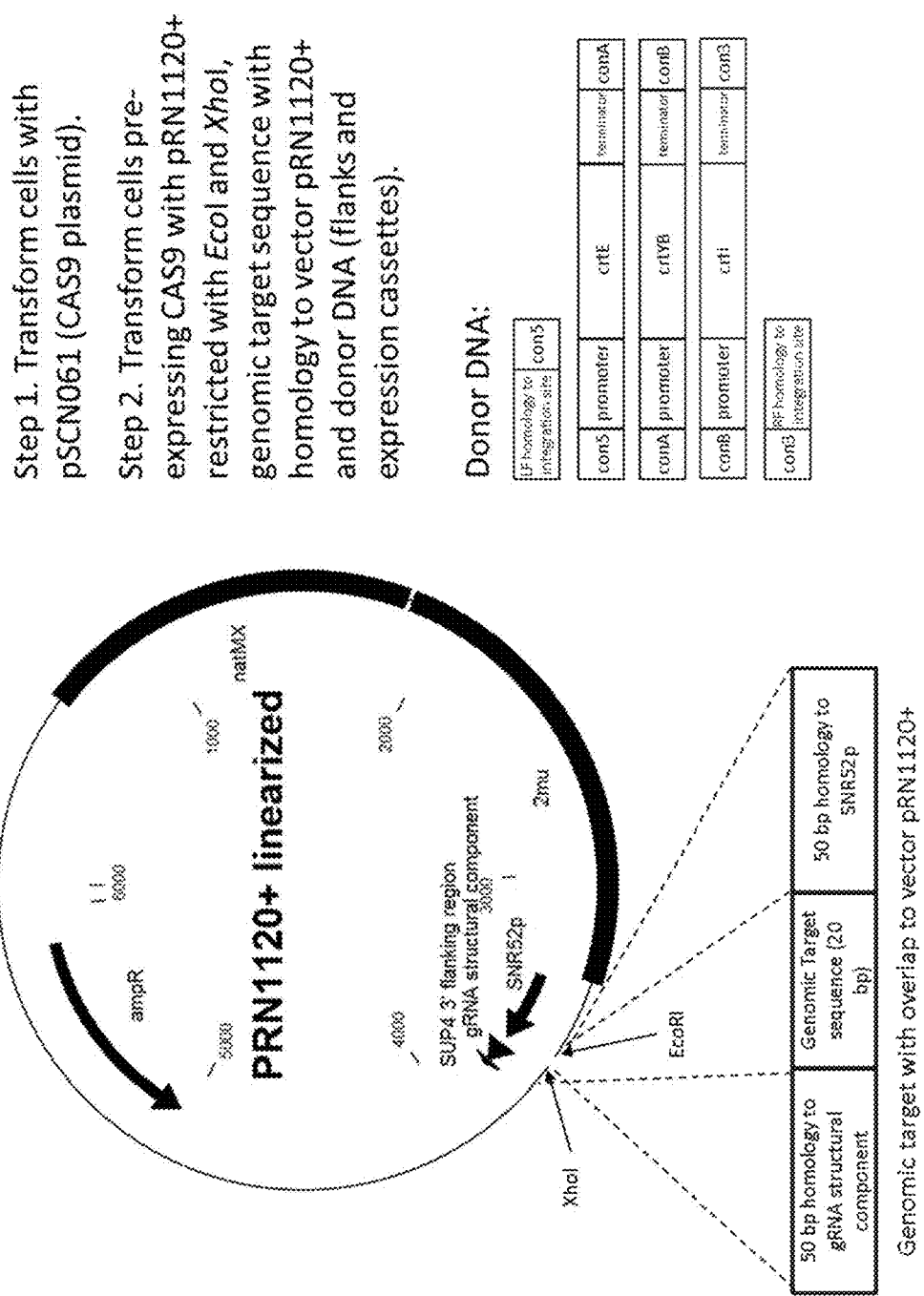

FIG. 31 depicts the singleplex transformation approach, where the genomic target sequence has homology with vector pRN1120+ and is able to recombine in vivo in yeast into linearized vector pRN1120+ by gap repair (Orr-Weaver et al., 1983). Integration of the donor DNA into genomic DNA is depicted in FIG. 23.

Figure 32:
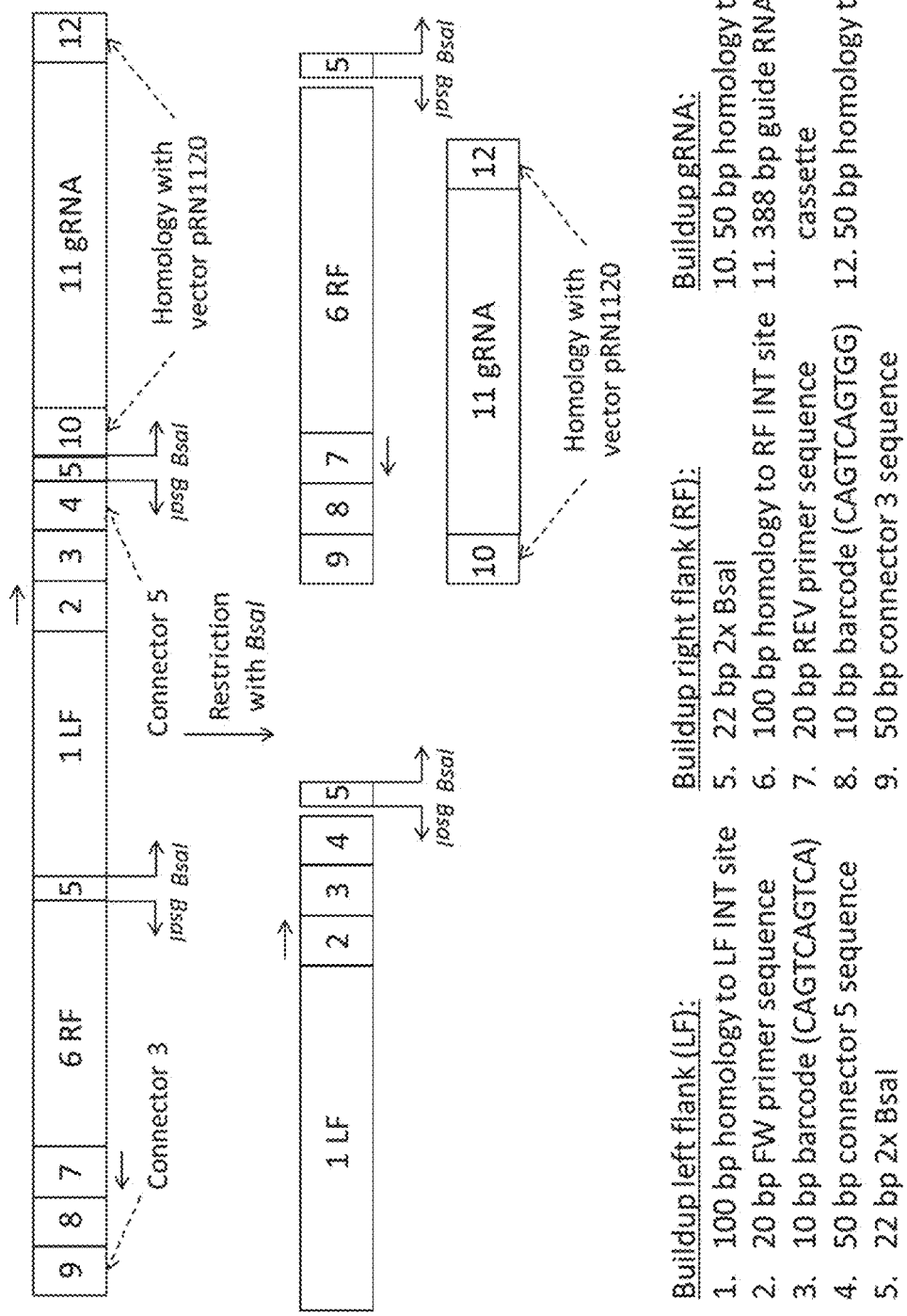

FIG. 32 depicts the DNA fragments used in the approach to delete up to 10 kb of genomic DNA by including multiple flank sequences in the transformation using CRISPR/CAS9.

Figure 33:
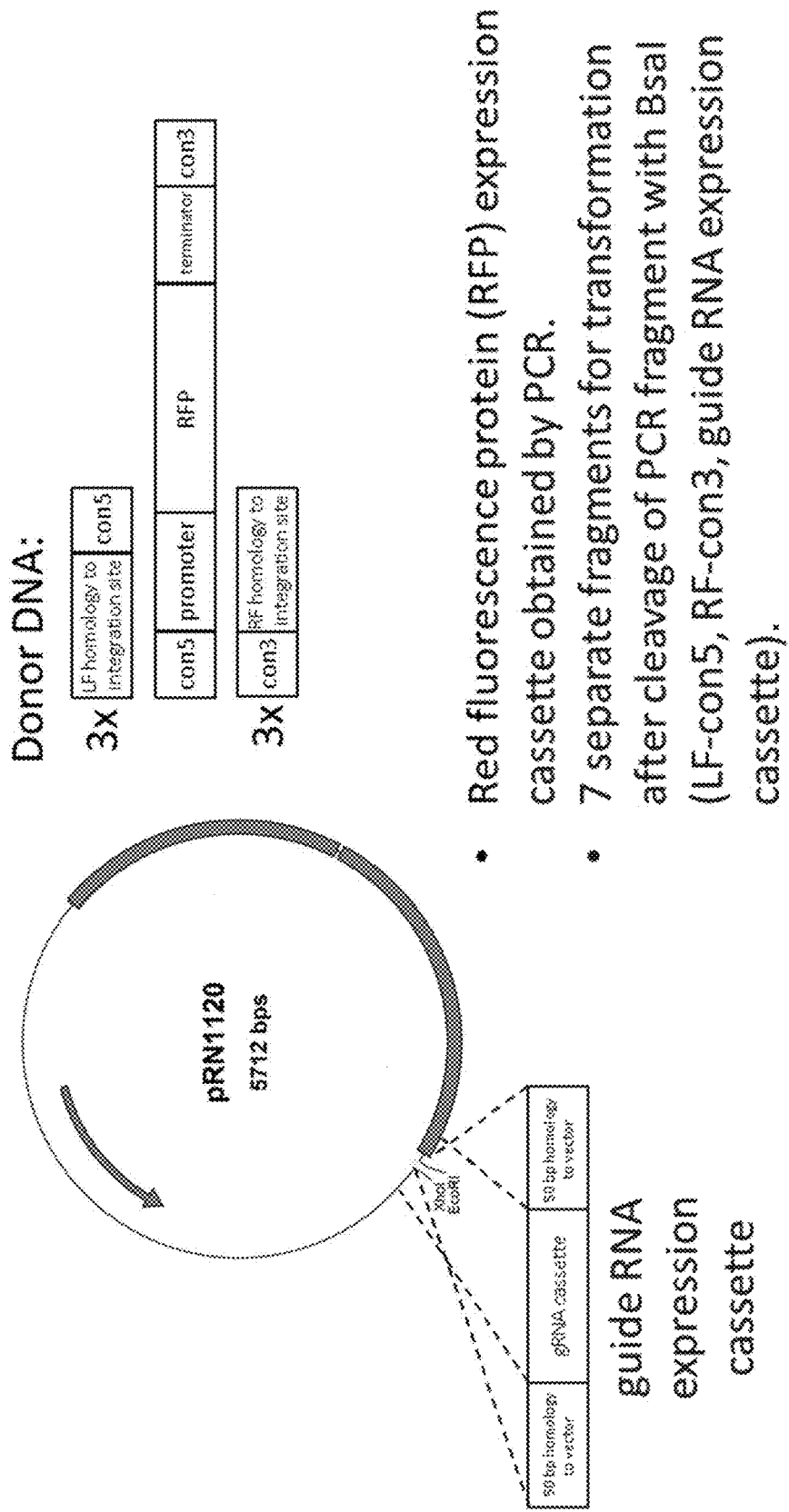

FIG. 33 depicts the transformation approach to delete up to 10 kb of genomic DNA by including multiple flank sequences in the transformation using CRISPR/CAS9. Step 1: Transform cells with pSCN061 (CAS9 plasmid). Step 2: Transform cells pre-expressing CAS9 with pRN1120 digested with XhoI, EcoRI, guide RNA and donor DNA.

Figure 34:
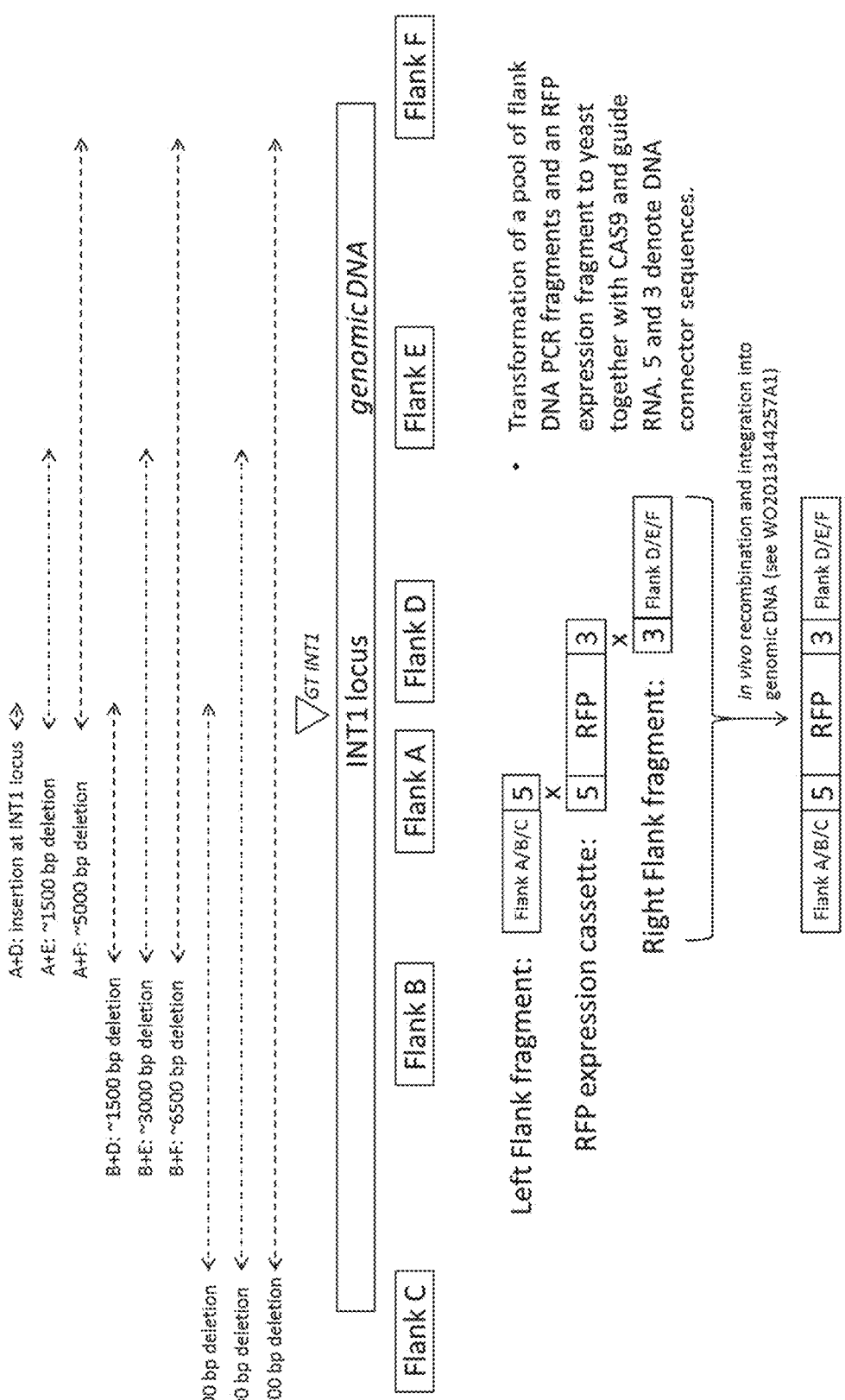

FIG. 34 depicts possible integration combinations and possible deletion sizes of genomic DNA when three different left flank and three different right flank PCR fragments, containing connector sequences, are transformed together with a RFP expression cassette, containing connector sequences. GT INT1 is the genomic target of the INT1 locus.

Figure 35:
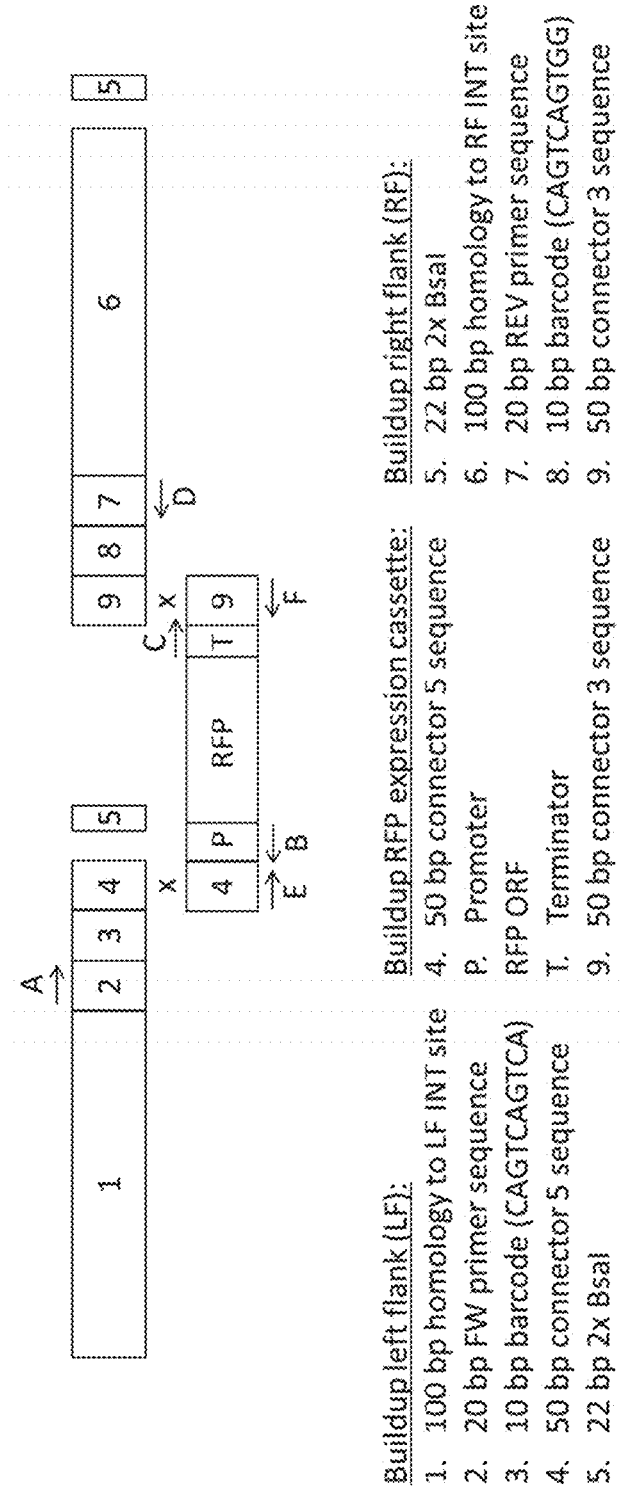

FIG. 35 depicts the PCR and sequencing approach to identify which flank sequences are integrated in order to determine which parts of genomic DNA is deleted.

DESCRIPTION OF THE SEQUENCE LISTING

SEQ ID NO: 1-4 empty.
SEQ ID NO: 5 sets out the genome of *Saccharomyces cerevisiae* CEN.PK113-7D.
SEQ ID NO: 6 sets out the genome of *Kluyveromyces lactis* NRRL Y-1140.
SEQ ID NO: 7 empty.
SEQ ID NO: 8 sets out a preferred termination sequence in yeast.

Sequences in Examples 1-13

SEQ ID NO: 9 sets out the nucleotide sequence of CAS9 including a C-terminal SV40 nuclear localization signal codon optimized for expression in human cells. The sequence includes TEF1 promoter and CYC1 terminator sequences from *Saccharomyces cerevisiae*.
SEQ ID NO: 10 sets out the nucleotide sequence of CAS9 including a C-terminal SV40 nuclear localization signal codon pair optimized for expression in *Saccharomyces cerevisiae*. The sequence includes TEF1 promoter and GND2 terminator sequences from *Saccharomyces cerevisiae*.
SEQ ID NO: 11 sets out the nucleotide sequence of CAS9 including a C-terminal SV40 nuclear localization signal codon pair optimized for expression in *Saccharomyces cerevisiae*. The sequence includes KI11 promoter from *Kluyveromyces lactis* and GND2 terminator sequence from *Saccharomyces cerevisiae*.
SEQ ID NO: 12 sets out the nucleotide sequence of CAS9 including a C-terminal SV40 nuclear localization signal codon pair optimized for expression in *Saccharomyces cerevisiae*. The sequence includes TDH3 promoter and GND2 terminator sequences from *Saccharomyces cerevisiae*.
SEQ ID NO: 13 sets out the nucleotide sequence of the kanamycin (KanMX) marker functional in *Saccharomyces cerevisiae*. The sequence includes NotI restriction sites.
SEQ ID NO: 14 sets out the nucleotide sequence of the nourseothricin (NatMX) marker functional in *Saccharomyces cerevisiae*. The sequence includes NotI restriction sites.
SEQ ID NO: 15 sets out the nucleotide sequence of the synthetic ADE2.Y gRNA cassette. The guide-RNA consists of the SNR52p RNA polymerase III promoter, the ADE2.Y guide-sequence (ACTTGAAGATTCTTTAGTGT; SEQ ID NO: 67), the gRNA structural component and the SUP4 3' flanking region. The sequence contains SacII restriction sites and homology to vector pRS426.
SEQ ID NO: 16 sets out the single stranded oligo nucleotide coding strand sequence (5' to 3' sequence) used to introduce a G to T mutation at nucleotide position 190 and a C to A mutation at position 236 in the ADE2 gene.
SEQ ID NO: 17 sets out the single stranded oligo nucleotide non-coding strand sequence (5' to 3' sequence) used to introduce a G to T mutation at nucleotide position 190 and a C to A mutation at position 236 in the ADE2 gene.

SEQ ID NO: 18 sets out the forward oligonucleotide primer sequences used to amplify the ADE2 gene from genomic DNA for DNA sequencing. This primer was also used as forward primer in the sequencing reaction.

SEQ ID NO: 19 sets out the reverse oligonucleotide primer sequences used to amplify the ADE2 gene from genomic DNA for DNA sequencing. This primer was also used as reverse primer in the sequencing reaction.

SEQ ID NO: 20 sets out the nucleotide sequence of the forward primer used to amplify the ADE2.Y gRNA cassette from SEQ ID NO: 7. The primer sequence contains overlap with the DNA of plasmid pCSNC (Table 1).

SEQ ID NO: 21 sets out the nucleotide sequence of the reverse primer used to amplify the ADE2.Y gRNA cassette from SEQ ID NO: 7. The primer sequence contains overlap with the DNA of plasmid pCSNC (Table 1).

SEQ ID NO: 22 sets out the nucleotide sequence of plasmid pRS426 in which the two SapI restriction sites were removed.

SEQ ID NO: 23 sets out the nucleotide sequence of the S. cerevisiae ADE2 gene (YOR128C).

SEQ ID NO: 24 sets out the nucleotide sequence of vector pCSN028.

SEQ ID NO: 25 sets out the nucleotide sequence of the S. cerevisiae HXT2 gene (YMR011W)

SEQ ID NO: 26 sets out the single stranded oligo nucleotide coding strand sequence (5' to 3' sequence) used to introduce A1082C, C1083A and C1104A mutations in the HXT2 gene.

SEQ ID NO: 27 sets out the single stranded oligo nucleotide non-coding strand sequence (5' to 3' sequence) used to introduce A1082C, C1083A and C1104A mutations in the HXT2 gene.

SEQ ID NO: 28 sets out the forward oligonucleotide primer sequences used to amplify the HXT2 gene from genomic DNA for DNA sequencing. This primer was also used as forward primer in the sequencing reaction.

SEQ ID NO: 29 sets out the reverse oligonucleotide primer sequences used to amplify the HXT2 gene from genomic DNA for DNA sequencing. This primer was also used as reverse primer in the sequencing reaction.

SEQ ID NO: 30 sets out the nucleotide sequence of the synthetic INT1A gRNA cassette. The guide-RNA consists of the SNR52p RNA polymerase III promoter, the INT1A guide-sequence (TATTAGAACCAGGGAGGTCC; SEQ ID NO: 68), the gRNA structural component and the SUP4 3' flanking region. The sequence contains SacII restriction sites and homology to vector pRS426.

SEQ ID NO: 31 sets out the forward oligonucleotide primer sequence used to amplify the 5'flank A from genomic DNA from strain CEN.PK113-7D. It also sets out the nucleotide sequence of forward primer F3, used to confirm the deletion at the INT1 locus (control) of genomic DNA.

SEQ ID NO: 32 sets out the reverse oligonucleotide primer sequence used to amplify the 5'flank A from genomic DNA from strain CEN.PK113-7D, and contains an overhang with connector 5 that is present in the RFP (or GFP) PCR fragment.

SEQ ID NO: 33 sets out the forward oligonucleotide primer sequence used to amplify the 3'flank A from genomic DNA from strain CEN.PK113-7D, and contains an overhang with connector 3 that is present in the RFP (or GFP) PCR fragment.

SEQ ID NO: 34 sets out the reverse oligonucleotide primer sequence used to amplify the 3'flank A from genomic DNA from strain CEN.PK113-7D. It also sets out the nucleotide sequence of reverse primer R3, used to confirm the deletion at the INT1 locus (control) of genomic DNA.

SEQ ID NO: 35 sets out the forward oligonucleotide primer sequence used to amplify the 5'flank B from genomic DNA from strain CEN.PK113-7D. It also sets out the nucleotide sequence of forward primer F3, used to confirm deletion of 1 kB of genomic DNA.

SEQ ID NO: 36 sets out the reverse oligonucleotide primer sequence used to amplify the 5'flank B from genomic DNA from strain CEN.PK113-7D, and contains an overhang with connector 5 that is present in the RFP PCR fragment.

SEQ ID NO: 37 sets out the forward oligonucleotide primer sequence used to amplify the 3'flank B from genomic DNA from strain CEN.PK113-7D, and contains an overhang with connector 3 that is present in the RFP PCR fragment.

SEQ ID NO: 38 sets out the reverse oligonucleotide primer sequence used to amplify the 3'flank B from genomic DNA from strain CEN.PK113-7D. It also sets out the nucleotide sequence of reverse primer R3, used to confirm deletion of 1 kB of genomic DNA.

SEQ ID NO: 39 sets out the forward oligonucleotide primer sequence used to amplify the 5'flank C from genomic DNA from strain CEN.PK113-7D. It also sets out the nucleotide sequence of forward primer F3, used to confirm deletion of 3 kB of genomic DNA.

SEQ ID NO: 40 sets out the reverse oligonucleotide primer sequence used to amplify the 5'flank C from genomic DNA from strain CEN.PK113-7D, and contains an overhang with connector 5 that is present in the RFP PCR fragment.

SEQ ID NO: 41 sets out the forward oligonucleotide primer sequence used to amplify the 3'flank C from genomic DNA from strain CEN.PK113-7D, and contains an overhang with connector 3 that is present in the RFP PCR fragment.

SEQ ID NO: 42 sets out the reverse oligonucleotide primer sequence used to amplify the 3'flank C from genomic DNA from strain CEN.PK113-7D. It also sets out the nucleotide sequence of reverse primer R3, used to confirm deletion of 3 kB of genomic DNA.

SEQ ID NO: 43 sets out the forward oligonucleotide primer sequence used to amplify the 5'flank D from genomic DNA from strain CEN.PK113-7D. It also sets out the nucleotide sequence of forward primer F3, used to confirm deletion of 10 kB of genomic DNA.

SEQ ID NO: 44 sets out the reverse oligonucleotide primer sequence used to amplify the 5'flank D from genomic DNA from strain CEN.PK113-7D, and contains an overhang with connector 5 that is present in the RFP PCR fragment.

SEQ ID NO: 45 sets out the forward oligonucleotide primer sequence used to amplify the 3'flank D from genomic DNA from strain CEN.PK113-7D, and contains an overhang with connector 3 that is present in the RFP PCR fragment.

SEQ ID NO: 46 sets out the reverse oligonucleotide primer sequence used to amplify the 3'flank D from genomic DNA from strain CEN.PK113-7D. It also sets out the nucleotide sequence of reverse primer R3, used to confirm deletion of 10 kB of genomic DNA.

SEQ ID NO: 47 sets out the forward oligonucleotide primer sequence used to amplify the RFP cassette (set out in SEQ ID NO: 41) and contains an overhang comprising the connector 5 sequence.

SEQ ID NO: 48 sets out the reverse oligonucleotide primer sequence used to amplify the RFP cassette (set out in SEQ ID NO: 49) and contains an overhang comprising the connector 3 sequence.

SEQ ID NO: 49 sets out the nucleotide sequence of the TPI1p-RFP-ENO1t.

SEQ ID NO: 50 sets out the nucleotide sequence of vector pCSN021.

SEQ ID NO: 51 sets out the nucleotide sequence of ACT1p-GFP-ADH1t.

SEQ ID NO: 52 sets out the forward oligonucleotide primer sequence used to amplify the GFP cassette (set out in SEQ ID NO: 51) and contains an overhang comprising the connector 5 sequence.

SEQ ID NO: 53 sets out the reverse oligonucleotide primer sequence used to amplify the GFP cassette (set out in SEQ ID NO: 43) and contains an overhang comprising the connector 3 sequence.

SEQ ID NO: 54 sets out the nucleotide sequence of the forward primer used to amplify the ADE2.Y gRNA cassette from SEQ ID NO: 15.

SEQ ID NO: 55 empty

SEQ ID NO: 56 sets out the nucleotide sequence of the INT1B 5' guide-sequence

SEQ ID NO: 57 sets out the nucleotide sequence of the INT1B 3' guide-sequence

SEQ ID NO: 58 sets out the nucleotide sequence of the INT1C 5' guide-sequence

SEQ ID NO: 59 sets out the nucleotide sequence of the INT1C 3' guide-sequence

SEQ ID NO: 60 sets out the nucleotide sequence of the INT1D 5' guide-sequence

SEQ ID NO: 61 sets out the nucleotide sequence of the INT1D 3' guide-sequence

SEQ ID NO: 62 sets out the nucleotide sequence of the ADE2.Y guide-RNA-ADE2.Y gBlock SEQ ID NO: 63 sets out the nucleotide sequence of the reverse primer to amplify the ADE2.Y guide-RNA-ADE2.Y donor DNA or DE2.Y guide-RNA-PAM-ADE2.Y guide-sequence ADE2.Y PCR fragment SEQ ID NO: 64 sets out the nucleotide sequence of the ADE2.Y guide-RNA-PAM-ADE2.Y guide sequence ADE2.Y gBlock SEQ ID NO: 65 sets out the nucleotide sequence of the synthetic ADE2.Y gRNA cassette. The guide-RNA consists of the SNR52p RNA polymerase III promoter, the ADE2.Y guide-sequence, the gRNA structural component and the SUP4 3' flanking region. This sequence is present in amongst others present in plasmid pCSN021.

SEQ ID NO: 66 sets out the nucleotide sequence of the synthetic INT1A gRNA cassette. The guide-RNA consists of the SNR52p RNA polymerase III promoter, the INT1A guide-sequence, the gRNA structural component and the SUP4 3' flanking region. This sequence is present in amongst others present in plasmid pCSN021.

SEQ ID NO: 67 sets out the ADE2.Y guide-sequence within the ADE2.Y gRNA depicted in SEQ ID NO: 15.

SEQ ID NO: 68 sets out the INT1A guide-sequence within the INT1A gRNA depicted in

SEQ ID NO: 30.

SEQ ID NO: 69-124 empty.

SEQ ID NO: 125 sets out the nucleotide sequence of forward primer F1, used to confirm correct integration of the RFP expression cassette in order obtain 10 kb deletion of genomic DNA.

SEQ ID NO: 126 sets out the nucleotide sequence of reverse primer R2, used to confirm correct integration of the RFP expression cassette in order obtain 10 kb deletion of genomic DNA.

SEQ ID NO: 127 sets out the nucleotide sequence of forward primer F1, used to confirm correct integration of the RFP expression cassette in order obtain 3 kb deletion of genomic DNA.

SEQ ID NO: 128 sets out the nucleotide sequence of reverse primer R2, used to confirm correct integration of the RFP expression cassette in order obtain 3 kb deletion of genomic DNA.

SEQ ID NO: 129 sets out the nucleotide sequence of forward primer F1, used to confirm correct integration of the RFP expression cassette in order obtain 1 kb deletion of genomic DNA.

SEQ ID NO: 130 sets out the nucleotide sequence of reverse primer R2, used to confirm correct integration of the RFP expression cassette in order obtain 1 kb deletion of genomic DNA.

SEQ ID NO: 131 sets out the nucleotide sequence of forward primer F1, used to confirm correct integration of the RFP expression cassette at the INT1 locus (control) of genomic DNA.

SEQ ID NO: 132 sets out the nucleotide sequence of reverse primer R2, used to confirm correct integration of the RFP expression cassette at the INT1 locus (control) of genomic DNA.

SEQ ID NO: 133 sets out the nucleotide sequence of reverse primer R1, used to confirm correct integration of the RFP expression cassette in order obtain 10, 3 or 1 kb deletion of genomic DNA or to confirm correct integration of the RFP expression cassette at the INT1 locus (control) of genomic DNA.

SEQ ID NO: 134 sets out the nucleotide sequence of forward primer F2, used to confirm correct integration of the RFP expression cassette in order obtain 10, 3 or 1 kb deletion of genomic DNA or to confirm correct integration of the RFP expression cassette at the INT1 locus (control) of genomic DNA.

SEQ ID NO: 135 sets out the nucleotide sequence of vector pCSN061.

SEQ ID NO: 136 sets out the nucleotide sequence of vector pRN1120.

SEQ ID NO: 137 sets out the nucleotide sequence of con5—Low strength promoter (KlTDH2p) -crtE-ScTDH3t-conA. Con denotes connector sequence.

SEQ ID NO: 138 sets out the nucleotide sequence of con5—Medium strength promoter (KlPGK1p)-crtE-ScTDH3t-conA.

SEQ ID NO: 139 sets out the nucleotide sequence of con5—Strong promoter (ScFBA1p)-crtE-ScTDH3t-conA.

SEQ ID NO: 140 sets out the nucleotide sequence of conA—Low strength promoter (KlYDRp)-crtYB-ScPDC1t-conB.

SEQ ID NO: 141 sets out the nucleotide sequence of conA—Medium strength promoter (KlTEF2p)-crtYB-ScPDC1t-conB.

SEQ ID NO: 142 sets out the nucleotide sequence of conA—Strong promoter (ScTEF1p)-crtYB-ScPDC1t-conB.

SEQ ID NO: 143 sets out the nucleotide sequence of conB—Low strength promoter (ScPRE3p)-crtI-ScTAL1t-conC.

SEQ ID NO: 144 sets out the nucleotide sequence of conB—Medium strength promoter (ScACT1p)-crtI-ScTAL1t-conC.

SEQ ID NO: 145 sets out the nucleotide sequence of conB—Strong promoter (KIENO1p)-crtI-ScTAL1t-conC.

SEQ ID NO: 146 sets out the nucleotide sequence of conB—Low strength promoter (ScPRE3p)-crtI-ScTAL1t-con3.

SEQ ID NO: 147 sets out the nucleotide sequence of conB—Medium strength promoter (ScACT1p)-crtI-ScTAL1t-con3.

SEQ ID NO: 148 sets out the nucleotide sequence of conB—Strong promoter (KIENO1p)-crtI-ScTAL1t-con3.

SEQ ID NO: 149 sets out the nucleotide sequence of INT1 Left Flank (LF)-con5. Con denotes connector sequence.

SEQ ID NO: 150 sets out the nucleotide sequence of INT59 LF-con5.

SEQ ID NO: 151 sets out the nucleotide sequence of YPRCtau3 LF-con5.

SEQ ID NO: 152 sets out the nucleotide sequence of con3-INT1 Right Flank (RF).

SEQ ID NO: 153 sets out the nucleotide sequence of con3-INT59 RF.

SEQ ID NO: 154 sets out the nucleotide sequence of con3-YPRCtau3 RF.

SEQ ID NO: 155 sets out the nucleotide sequence of primer con5 forward (FW).

SEQ ID NO: 156 sets out the nucleotide sequence of primer conA reverse (REV).

SEQ ID NO: 157 sets out the nucleotide sequence of primer conA FW.

SEQ ID NO: 158 sets out the nucleotide sequence of primer conB REV.

SEQ ID NO: 159 sets out the nucleotide sequence of primer conB FW.

SEQ ID NO: 160 sets out the nucleotide sequence of primer ScTAL1t rev with con3 flank (REV primer used to change conC to con3).

SEQ ID NO: 161 sets out the nucleotide sequence of primer INT1 5' FW.

SEQ ID NO: 162 sets out the nucleotide sequence of primer INT1 5' REV with con5 flank.

SEQ ID NO: 163 sets out the nucleotide sequence of primer INT59 5' FW.

SEQ ID NO: 164 sets out the nucleotide sequence of primer INT59 5' REV with con5 flank.

SEQ ID NO: 165 sets out the nucleotide sequence of primer YPRCtau3 5' FW.

SEQ ID NO: 166 sets out the nucleotide sequence of primer YPRCtau3 5' REV with con5 flank.

SEQ ID NO: 167 sets out the nucleotide sequence of primer con 3 flank-INT1 3' FW.

SEQ ID NO: 168 sets out the nucleotide sequence of primer INT1 3' REV.

SEQ ID NO: 169 sets out the nucleotide sequence of primer con 3 flank-INT59 3' FW.

SEQ ID NO: 170 sets out the nucleotide sequence of primer INT59 3' REV.

SEQ ID NO: 171 sets out the nucleotide sequence of primer con 3 flank-YPRCtau3 3' FW.

SEQ ID NO: 172 sets out the nucleotide sequence of primer YPRCtau3 3' REV.

SEQ ID NO: 173 sets out the nucleotide sequence of gBlock INT1 guide RNA singleplex.

SEQ ID NO: 174 sets out the nucleotide sequence of gBlock INT59 guide RNA singleplex.

SEQ ID NO: 175 sets out the nucleotide sequence of gBlock YPRCtau3 guide RNA singleplex.

SEQ ID NO: 176 sets out the nucleotide sequence of genomic target INT1.

SEQ ID NO: 177 sets out the nucleotide sequence of genomic target INT59 (INT2).

SEQ ID NO: 178 sets out the nucleotide sequence of genomic target YPRCtau3 (INT3).

SEQ ID NO: 179 sets out the nucleotide sequence of FW primer guide RNA cassette with pRN1120 overlap.

SEQ ID NO: 180 sets out the nucleotide sequence of REV primer guide RNA cassette with pRN1120 overlap.

SEQ ID NO: 181 sets out the nucleotide sequence of homology to INT1—Low strength promoter (KITDH2p)-crtE-ScTDH3t-homology to INT1.

SEQ ID NO: 182 sets out the nucleotide sequence of homology to INT1—Medium strength promoter (KIPGK1p)-crtE-ScTDH3t-homology to INT1.

SEQ ID NO: 183 sets out the nucleotide sequence of homology to INT1—Strong promoter (ScFBA1p)-crtE-ScTDH3t-homology to INT1.

SEQ ID NO: 184 sets out the nucleotide sequence of homology to INT2—Low strength promoter (KIYDR1p)-crtYB-ScPDC1t-homology to INT2.

SEQ ID NO: 185 sets out the nucleotide sequence of homology to INT2—Medium strength promoter (KITEF2p)-crtYB-ScPDC1t-homology to INT2.

SEQ ID NO: 186 sets out the nucleotide sequence of homology to INT2—Strong promoter (ScTEF1p)-crtYB-ScPDC1t-homology to INT2.

SEQ ID NO: 187 sets out the nucleotide sequence of homology to INT3—Low strength promoter (ScPRE3p)-crtI-ScTAL1t-homology to INT3.

SEQ ID NO: 188 sets out the nucleotide sequence of homology to INT3—Medium strength promoter (ScACT1p)-crtI-ScTAL1t-homology to INT3.

SEQ ID NO: 189 sets out the nucleotide sequence of homology to INT3—Strong promoter (KIENO1p)-crtI-ScTAL1t-homology to INT3.

SEQ ID NO: 190 sets out the nucleotide sequence of the FW primer to obtain SEQ ID NO: 181.

SEQ ID NO: 191 sets out the nucleotide sequence of the REV primer to obtain SEQ ID NO: 181, 182, 183.

SEQ ID NO: 192 sets out the nucleotide sequence of the FW primer to obtain SEQ ID NO: 182.

SEQ ID NO: 193 sets out the nucleotide sequence of the FW primer to obtain SEQ ID NO: 183.

SEQ ID NO: 194 sets out the nucleotide sequence of the FW primer to obtain SEQ ID NO: 184.

SEQ ID NO: 195 sets out the nucleotide sequence of the REV primer to obtain SEQ ID NO: 184, 185, 186.

SEQ ID NO: 196 sets out the nucleotide sequence of the FW primer to obtain SEQ ID NO: 185.

SEQ ID NO: 197 sets out the nucleotide sequence of the FW primer to obtain SEQ ID NO: 186.

SEQ ID NO: 198 sets out the nucleotide sequence of the FW primer to obtain SEQ ID NO: 187.

SEQ ID NO: 199 sets out the nucleotide sequence of the REV primer to obtain SEQ ID NO: 187, 188, 189.

SEQ ID NO: 200 sets out the nucleotide sequence of the FW primer to obtain SEQ ID NO: 188.

SEQ ID NO: 201 sets out the nucleotide sequence of the FW primer to obtain SEQ ID NO: 189.

SEQ ID NO: 202 sets out the nucleotide sequence of gBlock INT1 guide RNA cassette multiplex approach 2.

SEQ ID NO: 203 sets out the nucleotide sequence of gBlock INT2 (INT59) guide RNA cassette multiplex approach 2.

SEQ ID NO: 204 sets out the nucleotide sequence of gBlock INT3 (YPRCtau3) guide RNA cassette multiplex approach 2.

SEQ ID NO: 205 sets out the nucleotide sequence of the REV primer to obtain the gRNA INT1 multiplex approach 2 PCR fragment.

SEQ ID NO: 206 sets out the nucleotide sequence of the FW primer to obtain the gRNA INT1 multiplex approach 2 PCR fragment.

SEQ ID NO: 207 sets out the nucleotide sequence of the REV primer to obtain the gRNA INT1 multiplex approach 2 PCR fragment.

SEQ ID NO: 208 sets out the nucleotide sequence of the FW primer to obtain the gRNA INT1 multiplex approach 2 PCR fragment.

SEQ ID NO: 209 sets out the nucleotide sequence of the left flank (LF) INT1-con5 part of flank_DNA-gRNA gBlock_1 and flank_DNA-gRNA gBlock_2.

SEQ ID NO: 210 sets out the nucleotide sequence of the con3-right flank (RF) INT1 part of flank_DNA-gRNA gBlock_1 and flank_DNA-gRNA gBlock_2.

SEQ ID NO: 211 sets out the nucleotide sequence of the forward primer used to amplify the flank_DNA-gRNA gBlock_1 and flank_DNA-gRNA gBlock_2 sequences.

SEQ ID NO: 212 sets out the nucleotide sequence of the reverse primer used to amplify the flank_DNA-gRNA gBlock_1 and flank_DNA-gRNA gBlock_2 sequences.

SEQ ID NO: 213 sets out the nucleotide sequence of the guide RNA expression cassette, with an INT1 genomic target sequence, containing 50 bp overlap with vector pRN1120 at the 5' and 3' ends of the sequence. The guide RNA expression cassette is part of the flank_DNA-gRNA gBlock_1 and flank_DNA-gRNA gBlock_2 sequences.

SEQ ID NO: 214 sets out the nucleotide sequence of flank_DNA-gRNA gBlock_1.

SEQ ID NO: 215 sets out the nucleotide sequence of flank_DNA-gRNA gBlock_2.

SEQ ID NO: 216 sets out the nucleotide sequence of guide RNA expression cassette with 100 bp overlap with vector pRN1120 at the 5' and 3' ends of the sequence, the genomic target is surrounded by an EcoRI and a XhoI restriction site.

SEQ ID NO: 217 sets out the nucleotide sequence of vector pRN1120+, obtained after in vivo recombination by gap repair of SEQ ID NO: 216 into linearized pRN1120 in yeast (Orr-Weaver et al., 1983).

SEQ ID NO: 218 sets out the nucleotide sequence of flank_DNA-gRNA gBlock_3.

SEQ ID NO: 219 sets out the nucleotide sequence of flank_DNA-gRNA gBlock_4.

SEQ ID NO: 220 sets out the nucleotide sequence of the 50 bp homology with linearized pRN1120+(part of SNR52p), INT1 genomic target 20 bp), 50 bp homology with linearized pRN1120+(part of guide RNA structural component).

SEQ ID NO: 221 sets out the nucleotide sequence of gBlockINT1-100-0-BAR-2.

SEQ ID NO: 222 sets out the nucleotide sequence of gBlockINT1-100-1500-BAR-2.

SEQ ID NO: 223 sets out the nucleotide sequence of gBlockINT1-100-5000-BAR-2.

SEQ ID NO: 224 sets out the nucleotide sequence of forward primer E to confirm integration of the RFP expression cassette.

SEQ ID NO: 225 sets out the nucleotide sequence of reverse primer F to confirm integration of the RFP expression cassette.

SEQ ID NO: 226 sets out the nucleotide sequence forward primer A to obtain a PCR product for sequencing the barcode present in the left flank sequence integrated in genomic DNA (see FIG. 35).

SEQ ID NO: 227 sets out the nucleotide sequence of reverse primer B to obtain a PCR product for sequencing the barcode present in the left flank sequence integrated in genomic DNA (see FIG. 35). This is also a sequencing primer to be used in the sequencing reaction.

SEQ ID NO: 228 sets out the nucleotide sequence of forward primer C to obtain a PCR product for sequencing the barcode present in the right flank sequence integrated in genomic DNA (see FIG. 35). This is also a sequencing primer to be used in the sequencing reaction.

SEQ ID NO: 229 sets out the nucleotide sequence of reverse primer D to obtain a PCR product for sequencing the barcode present in the right flank sequence integrated in genomic DNA (see FIG. 35).

DETAILED DESCRIPTION OF THE INVENTION

In a first aspect, the present invention provides a non-naturally occurring or engineered composition comprising a source of a CRISPR-Cas system comprising a guide-polynucleotide and a Cas protein, wherein the guide-polynucleotide comprises a guide-sequence that essentially is the reverse complement of a target-polynucleotide in a host cell and the guide-polynucleotide can direct binding of the Cas protein at the target-polynucleotide in the host cell to form a CRISPR-Cas complex, wherein the guide-sequence is essentially the reverse complement of the (N)y part of a 5'-(N)yPAM-3' polynucleotide sequence target in the genome of the host cell, wherein y is an integer of 8-30, more preferably 10-30, more preferably 15-30, more preferably 17-27, more preferably 17-20, more preferably 17, 18, 19, 20, 21, 22, 23, 24, 25, 26, or 27, wherein PAM is a protospacer adjacent motif, wherein the host cell is a eukaryote, which eukaryote is a yeast, preferably a *Saccharomyces* or a *Kluyveromyces* and wherein PAM is preferably a sequence selected from the group consisting of 5'-XGG-3', 5'-XGGXG-3', 5'-XXAGAAW-3', 5'-XXXXGATT-3', 5'-XXAGAA-3', 5'-XAAAAC-3', wherein X can be any nucleotide or analog thereof, preferably X can be any nucleotide; and W is A or T. Preferred genomes of *Saccharomyces* and *Kluyveromyces* are the genomes represented by SEQ ID NO's: 5 and 6 respectively. Unknown or ambiguous nucleotides in a genome (such as a nucleotide depicted with "n") are preferably excluded as polynucleotide sequence target.

The composition, source, CRISPR-Cas system, guide-polynucleotide, Cas protein, target-polynucleotide, host cell and CRISPR-Cas complex are herein referred to as a composition, source, CRISPR-Cas system, guide-polynucleotide, Cas protein, target-polynucleotide, host cell and CRISPR-Cas complex according to the present invention. For the sake of completeness, since "a" is defined elsewhere herein as "at least one", a composition according to the present invention comprises a source of at least one, i.e. one, two, three or more guide-polynucleotides and/or at least one, i.e. one, two, three or more Cas proteins. Accordingly, the present invention conveniently provides for a multiplex CRISPR-Cas system. Such multiplex CRISPR-Cas system can conveniently be used for introduction of a donor polynucleotide, deletion of a polynucleotide and polynucleotide library insertion into the genome of a host cell. Herein, a multiplex CRISPR-Cas system may refer to the use of one of more Cas proteins, one of more guide-polynucleotides and/or one or more donor polynucleotides. Herein, when a combination of a single guide-polynucleotide and multiple donor polynucleotides is used wherein the donor polynucleotides are configured such that they will be introduced into a single target locus, the term "singleplex" is used. Such is exemplified, but not limited to, the procedure depicted in FIGS. 23 and 24.

The terms "CRISPR system", "CRISPR-Cas system" and "CRISPR enzyme system" are used interchangeably herein and refer in the context of all embodiments of the present invention to a collection of elements required to form, together with a target-polynucleotide, a CRISPR-Cas complex; these elements comprise but are not limited to a Cas protein and a guide-polynucleotide.

The term "CRISPR-Cas complex" refers in the context of all embodiments of the present invention to a complex comprising a guide-polynucleotide hybridized to a target-polynucleotide and complexed with a Cas protein. In the most straightforward form, where a non-mutated Cas protein is used such as but not limited to the Cas9 protein of *Streptococcus pyogenes*, the formation of the CRISPR-Cas complex results in cleavage of one or both polynucleotide strands in or near (e.g. within 1, 2, 3, 4, 5, 6, 7, 8, 9, 10, 20, 50, or more base pairs from) the target-polynucleotide. Typically, a target-polynucleotide according to the present invention (defined below herein) is associated with a PAM sequence (defined below herein) and the PAM sequence is preferably immediately downstream (3') of the target-polynucleotide; the formation of the CRISPR-Cas complex typically results in cleavage of one or both polynucleotide strands 3 base pairs upstream (5') of the PAM sequence.

The term "non-naturally occurring composition" refers in the context of all embodiments of the present invention to a composition that in its form used in the present invention does not occur in nature. The individual elements may e.g. occur as such or in combinations with other elements in nature, but the non-naturally occurring composition comprises e.g. at least one element more or less than a naturally occurring composition.

The term "engineered composition" refers in the context of all embodiments of the present invention to a composition wherein at least one of the elements has been engineered, i.e. modified by man, in such a way that resulting element does not occur in nature. It follows that by virtue of comprising at least one engineered element, an engineered composition does not occur in nature.

The terms "polynucleotide", "nucleotide sequence" and "nucleic acid" are used interchangeably herein and refer in the context of all embodiments of the present invention to a polymeric form of nucleotides of any length, either deoxyribonucleotides or ribonucleotides, or mixes or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, oligonucleotides and primers. A polynucleotide may comprise one or more modified nucleotides, such as a methylated nucleotide and a nucleotide analogue or nucleotide equivalent wherein a nucleotide analogue or equivalent is defined as a residue having a modified base, and/or a modified backbone, and/or a non-natural internucleoside linkage, or a combination of these modifications. Preferred nucleotide analogues and equivalents are described in the section "General definitions". As desired, modifications to the nucleotide structure may be introduced before or after assembly of the polynucleotide. A polynucleotide may be further modified after polymerization, such as by conjugation with a labeling compound. A guide-polynucleotide according to the present invention comprises at least a guide-sequence that is able to hybridize with the target-polynucleotide and is able to direct sequence-specific binding of the CRISPR-Cas system to the target-polynucleotide to form a CRISPR-Cas complex. In order to enable formation of an active CRISPR-Cas complex, the guide-polynucleotide preferably also comprises a sequence that has a specific secondary structure and allows binding of the Cas protein to the guide-polynucleotide. Such sequence is known in the art as tracrRNA, tracr sequence, tracr scaffold or guide-polynucleotide structural component, these terms are used interchangeably herein; wherein the tracr is the abbreviation for transactivating CRISPR; tracrRNA thus means transactivating CRISPR RNA. The tracrRNA in the original CRISPR-Cas system is the endogenous bacterial RNA that links the crRNA (guide-sequence) to the Cas nuclease, being able to bind any crRNA. A guide-polynucleotide structural component may be comprised of a single polynucleotide molecule or may be comprised of two or more molecules hybridized to each other; such hybridizing components of a guide-polynucleotide structural component may be referred to as a tracr sequence and a tracr-mate sequence.

Accordingly, the guide-polynucleotide preferably also comprises a tracr sequence and/or a tracr-mate sequence. The guide-polynucleotide is a polynucleotide according to the general definition of a polynucleotide set out here above; a preferred guide-polynucleotide comprises ribonucleotides, a more preferred guide-polynucleotide is a RNA (guide-RNA).

In the context of the present invention, a guide-sequence is referred to as essentially the reverse complement of a target-sequence or of a target-polynucleotide if the subject sequence is able to hybridize with the target-sequence or target-polynucleotide, preferably under physiological conditions as in a host cell. The degree of complementarity between a guide-sequence and its corresponding target-sequence, when optimally aligned using a suitable alignment algorithm, is preferably higher than 50%, 60%, 75%, 80%, 85%, 90%, 95%, 97.5%, 99% sequence identity. Optimal alignment may be determined using any suitable algorithm for aligning sequences, preferably an algorithm as defined herein under "Sequence identity". When the target-polynucleotide is a double stranded polynucleotide, the subject sequence, such as a guide-sequence, may be able to hybridize with either strand of the target-polynucleotide e.g. a coding strand or a non-coding strand.

Preferably, a guide-sequence according to the present invention targets a target-sequence that is unique in the target. Preferably, a guide-sequence according to the present invention has 100% sequence identity with the 8, 9, 10, 11, 12, 13, 14, 15, 16, 17, 18, 19 or 20, more preferably 8, 9, 10, 11 or 12 nucleotides in the target-polynucleotide immediately adjacent to a PAM sequence.

A guide-sequence according to the present invention preferably is 8-30, more preferably 10-30, more preferably 15-30, more preferably 17-27, more preferably 17-20, more preferably 17, 18, 19, 20, 21, 22, 23, 24, 25, 26, or 27 nucleotides in length. The ability of a guide-sequence to direct sequence-specific binding of a CRISPR-Cas system to a target-sequence to form a CRISPR-Cas complex may be assessed by any suitable assay. For example, the components of a CRISPR system sufficient to form a CRISPR-Cas complex, including the guide-sequence to be tested, may be provided to a host cell having the corresponding target-sequence, such, as by transfection with vectors encoding the components of the CRISPR-Cas system, followed by an assessment of preferential cleavage within the target-sequence, such as by the Surveyor assay (Surveyor® Mutation Detection Kits distributed by Integrated DNA Technologies, Leuven, Belgium) or another sequence analysis assay such as sequencing. Cleavage of a target-polynucleotide may be evaluated in a test tube by providing the target-polynucleotide, components of a CRISPR-Cas system, including the guide-sequence to be tested and a control guide-sequence different from the test guide-sequence, and comparing binding or rate of cleavage at the target-sequence between the test and control guide-sequence reactions. Other assays are possible, and are known to a person skilled in the art.

A guide-polynucleotide structural component is believed to be necessary for formation of an active CRISPR-Cas complex. The guide-polynucleotide structural component is believed not necessarily to be operably linked to the guide-sequence; however, a guide-polynucleotide structural component may be operably linked to a guide-sequence within a guide-polynucleotide. A guide-polynucleotide structural component according to the present invention, which may comprise or consist of all or a portion of a wild-type guide-polynucleotide structural component (e.g. about or more than about 20, 26, 32, 45, 48, 54, 63, 67, 85, or more nucleotides of a wild-type tracr-sequence) forms part of a CRISPR-Cas complex; e.g. by hybridization of at least a portion of a tracr-sequence according to the present invention to all or a portion of a tracr-mate sequence according to the present invention and preferably operably linked to a guide-sequence according to the present invention. A tracr-sequence according to the present invention has sufficient complementarity to a tracr-mate sequence according to the present invention to hybridize, preferably under physiological condition as in a host cell, and facilitate formation of a CRISPR-Cas complex. As with the target-sequence according to the present invention, it is believed that complete complementarity is not needed, provided there is sufficient complementarity to be functional. Preferably, the tracr-sequence according to the present invention has at least 50%, 60%, 70%, 80%, 90%, 95% or 99% sequence identity along the length of the tracr-mate sequence according to the present invention when optimally aligned. Optimal alignment may be determined using any suitable algorithm for aligning sequences, preferably an algorithm as defined herein under "Sequence identity".

In general, a tracr mate sequence according to the present invention includes any sequence that has sufficient complementarity with a tracr sequence according to the present invention to promote formation of a CRISPR-Cas complex at a target-sequence, wherein the CRISPR-Cas complex comprises the tracr mate sequence according to the present invention hybridized to the tracr sequence according to the present invention. The degree of complementarity of the tracr sequence according to the present invention and the tracr mate sequence according to the present invention is preferably defined with respect to optimal alignment of the tracr mate sequence and tracr sequence along the length of the shorter of the two sequences. Optimal alignment may be determined using any suitable algorithm for aligning sequences, preferably an algorithm as defined herein under "Sequence identity".

Preferably, with respect to a tracr mate sequence according to the present invention and a tracr sequence according to the present invention, secondary structures are taken into account, such as self-complementarity within either the tracr sequence or tracr mate sequence. Preferably, the degree of complementarity between the tracr sequence according to the present invention and tracr mate sequence according to the present invention along the length of the shorter of the two sequences when optimally aligned is higher than 50%, 60%, 75%, 80%, 85%, 90%, 95%, 97.5%, 99% sequence identity. Preferably, the tracr mate sequence according to the present invention is 5, 6, 7, 8, 9, 10, 11, 12, 13, 14, 15, 16, 17, 18, 19, 20, 25, 30, 40, 50, or more nucleotides in length. Preferably, the tracer sequence according to the present invention is 5, 6, 7, 8, 9, 10, 11, 12, 13, 14, 15, 16, 17, 18, 19, 20, 25, 30, 40, 50, or more nucleotides in length. Preferably, the tracr sequence according to the present invention and tracr mate sequence, i.e. the guide-polynucleotide structural component according to the present invention are comprised within a single transcript, such that hybridization between the two produces a hybridization complex comprising a secondary structure, such as a hairpin. Such hybridization complex may also be formed when the tracr sequence and the tracr mate sequence are not comprised in a single transcript. Preferred loop forming sequences in a tracr sequence according to the present invention and/or a tracr mate sequence according to the present invention and/or guide-polynucleotide structural component according to the present invention for formation of hairpin structures are four nucleotides in length, and most preferably have the sequence GAAA; longer or shorter loop sequences may be used, as may alternative sequences. The loop sequences preferably include a nucleotide triplet (for example, AAA), and an additional nucleotide (for example C or G). Examples of loop forming sequences include CAAA and AAAG. Preferably, a tracr sequence according to the present invention and/or tracr mate sequence according to the present invention or hybridization complex thereof and/or guide-polynucleotide structural component according to the present invention comprises or is able to form at least two or more hairpins. More preferably, a tracr sequence according to the present invention and/or tracr mate sequence according to the present invention or hybridization complex thereof and/or guide-polynucleotide structural component according to the present invention comprises or is able to form two, three, four or five hairpins. Preferably, a tracr sequence according to the present invention and/or tracr mate sequence according to the present invention or hybridization complex thereof and/or guide-polynucleotide structural component according to the present invention comprises or is able to form at most five hairpins. Preferably, the single transcript of a tracr sequence according to the present invention and a tracr-mate sequence according to the present invention or hybridization complex of a tracr sequence according to the present invention and a tracr mate sequence according to the present invention and/or guide-polynucleotide structural component according to the present invention further comprises a transcription termination sequence; preferably this is a polyT sequence, for example six T nucleotides or, preferred for yeast, TTTTTTT-GTTTTTTATGTCT (SEQ ID NO: 8). As said, guide-polynucleotide structural components are known to the person skilled in the art; background information can e.g. be found in Gaj et al, 2013.

In the context of all embodiments according to the present invention, the term "target-polynucleotide" refers to a target-sequence according to the present invention to which a guide-sequence according to the present invention is designed to have complementarity, where hybridization between a target-sequence according to the present invention and a guide-sequence according to the present invention promotes the formation of a CRISPR-Cas complex. Full complementarity is not necessarily required, provided there is sufficient complementarity to cause hybridization and promote formation of a CRISPR-Cas complex. Preferably, a guide-sequence according to the present invention targets a target-sequence that is unique in the target. Preferably, a guide-sequence according to the present invention has 100% sequence identity with the 8, 9, 10, 11, 12, 13, 14, 15, 16, 17, 18, 19 or 20, more preferably 8, 9, 10, 11 or 12 nucleotides in the target-polynucleotide immediately adjacent to a PAM sequence. A target-polynucleotide according to the present invention may comprise any polynucleotide, such as DNA or RNA polynucleotides and may be single or double stranded. When the target-polynucleotide is a double strand polynucleotide, a guide-sequence according to the present invention, may be able to hybridize with either strand of the target-polynucleotide e.g. a coding strand or a non-coding strand.

A target-polynucleotide according to the present invention may be located in the nucleus or cytoplasm of a cell. A target-polynucleotide according to the present invention may be located in an organelle of a host cell, for example in a mitochondrion or chloroplast. A target-polynucleotide according to the present invention may be comprised in a genome, may be comprised in a chromosome or may be extra-chromosomal, may be comprised in an artificial chromosome such a Yeast Artificial Chromosome (YAC), may be present in any chromosomal entity or extra-chromosomal entity such as an autosomal replicating entity such as an episomal plasmid or vector. A target-polynucleotide according to the present invention may be native or foreign to the host cell.

A target-polynucleotide according to the present invention is preferably associated with a protospacer adjacent motif (PAM), which is a short polynucleotide recognized by the CRISPR-Cas complex. Preferably, the target-polynucleotide and PAM are linked wherein the PAM is preferably immediately downstream (3') of the target-polynucleotide. The exact sequence and length of the PAM may vary, e.g. different Cas proteins may require different PAM's. A preferred PAM according to the present invention is a polynucleotide of 2 to 8 nucleotides in length. A preferred PAM is selected from the group consisting of 5'-XGG-3', 5'-XG-GXG-3', 5'-XXAGAAW-3', 5'-XXXXGATT-3', 5'-XX-AGAA-3', 5'-XAAAAC-3', wherein X can be any nucleotide or analog thereof, preferably any nucleotide; and W is A or T. A more preferred PAM is 5'-XGG-3'. The PAM is preferably matched with the Cas protein. The most widely used CAS/CRISPR system is derived from *S. pyogenes* and the matching PAM sequence 5'-XGG-3' is located immediately downstream (3') of the target-sequence. A preferred PAM for a *Neisseria meningitidis* Cas protein is 5'-XXXXGATT-3'; a preferred PAM for a *Streptococcus thermophilus* Cas protein is 5'-XXAGAA-3'; a preferred PAM for a *Treponema denticola* is 5'-XAAAAC-3'. A preferred PAM matches the Cas protein used. A Cas protein according to the present invention may be engineered to match a different PAM than the native PAM matching the wild-type Cas protein. As such, the CRISPR-Cas system according to the present invention may be used for customized specific targeting.

The term "hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence-specific manner. The complex may comprise two strands forming a duplex structure, three or more strands forming a multi stranded complex, a single self-hybridizing strand, or any combination of these. A hybridization reaction may constitute a step in a more extensive process, such as the cleavage of a polynucleotide by an enzyme. Preferred hybridization conditions are physiological conditions as within a host cell according to the present invention.

The term "source" in the context of all embodiments of the present invention refers to any source of a CRISPR-Cas system comprising a guide-polynucleotide and a Cas protein. The guide-polynucleotide and Cas protein may be present in separate sources. In such case, the composition according to the present invention comprises a CRISPR-Cas system comprising a source of a guide-polynucleotide and a source of a Cas-protein. Any source means that the guide-polynucleotide and Cas protein may be present as such in a form that they can function within a CRISPR-Cas system. The guide-polynucleotide and/or the Cas-protein may be provided in its active forms and may e.g. be provided from an inactive form or from another entity. The guide-polynucleotide may e.g. be present on another polynucleotide or may be encoded by a polynucleotide that is transcribed to provide for the actual guide-polynucleotide. The Cas protein may be encoded by a polynucleotide (e.g. DNA or mRNA) that is transcribed and/or translated to provide the actual Cas protein. An encoding polynucleotide may be present in a nucleic acid construct as defined herein and/or in a vector as defined herein. Such nucleic acid construct and vector are herein referred to as a nucleic acid construct according to the present invention and a vector according to the present invention.

Preferably, in the composition according to the present invention, the Cas protein is encoded by a polynucleotide and/or the guide-polynucleotide is encoded by or present on a polynucleotide.

Preferably, in the composition according to the present invention, the Cas protein is encoded by a polynucleotide and/or the guide-polynucleotide is encoded by or present on another polynucleotide and the polynucleotide or polynucleotides are comprised in a vector.

Preferably, in a composition according to the invention, the guide-polynucleotide is encoded by a polynucleotide that is transcribed to provide for the actual guide-polynucleotide. Accordingly, in an embodiment, in the composition according to the invention, preferably, the guide polynucleotide is present in the form of a polynucleotide encoding for said guide-polynucleotide and the guide-polynucleotide is obtained upon transcription of said polynucleotide in the host cell.

Preferably, in a composition according to the invention, the polynucleotide encoding a guide-polynucleotide has sequence identity with a vector such that recombination of the polynucleotide encoding the guide-polynucleotide and said vector is facilitated, wherein the recombination preferably is in vivo recombination in the host cell and wherein the vector is preferably linear. Accordingly, in an embodiment, in the composition according to the invention, preferably, a polynucleotide encoding a guide-polynucleotide has one or more regions of sequence identity with a first vector to allow homologous recombination between the polynucleotide encoding the guide-polynucleotide and said first vector to yield a second vector comprising the polynucleotide encoding the guide polynucleotide, wherein the recombination preferably is in vivo recombination in the host cell and wherein the first vector is preferably a linear vector. The person skilled in the art knows how to provide a linear vector; it can e.g. be synthesized as such or can be provided by restriction enzyme digestion of a circular vector. This embodiment is exemplified, but not limited to, FIG. 24. It allows the design of several distinct polynucleotides encoding a guide-polynucleotide that have homology with the vector without having to clone each polynucleotide encoding a guide-polynucleotide into the vector.

Preferably, such composition according to the invention comprises at least two distinct polynucleotides each encoding a respective distinct guide-polynucleotide, wherein said at least two polynucleotides additionally comprise sequence identity with each other such that recombination of the polynucleotides encoding the distinct guide-polynucleotides and said vector is facilitated, wherein the recombination preferably is in vivo recombination in the host cell and wherein the vector is preferably a linear vector. Accordingly, in an embodiment, the composition according to the invention preferably comprises at least two distinct polynucleotides each encoding a respective distinct guide-polynucleotide, wherein said at least two polynucleotides additionally comprise sequence identity with each other to allow homologous recombination of the polynucleotides encoding the distinct guide-polynucleotides with each other and with said (first) vector to yield a second vector comprising said at least two polynucleotides encoding each a guide-polynucleotide, wherein the recombination preferably is in vivo recombination in the host cell and wherein the (first) vector is preferably a linear vector. The embodiment is exemplified, but not limited to, FIG. 26, Approach 2. In an embodiment, the guide-polynucleotides are preferably distinct in their sequence identity with the target-polynucleotide.

In a variant embodiment, the polynucleotide encoding a guide-polynucleotide does not have sequence identity with a vector or another polynucleotide encoding a guide-polynucleotide itself, but an additional polynucleotide is present in the composition according to the invention that facilitates assembly of the polynucleotide encoding a guide-polynucleotide into the vector and/or assembly of a complex of two distinct polynucleotides each encoding a respective distinct guide-polynucleotide.

Accordingly, there is provided a composition according to the invention, wherein an additional set of polynucleotides is present that has sequence identity with a polynucleotide encoding a guide-polynucleotide and with a vector such that recombination of the polynucleotide encoding the guide-polynucleotide and said vector is facilitated, wherein the recombination preferably is in vivo recombination in the host cell and wherein the vector is preferably linear. In addition, there is provided a composition according to the invention, wherein a further polynucleotide is present that has sequence identity with a polynucleotide encoding the guide-polynucleotide and with a further and distinct polynucleotide encoding a further and distinct guide-polynucleotide such that recombination of the polynucleotides encoding the guide-polynucleotides and said vector is facilitated, wherein the recombination preferably is in vivo recombination in the host cell and wherein the vector is preferably linear.

Preferably, in the composition according to the present invention, the Cas protein is encoded by a polynucleotide and the guide-polynucleotide is encoded by or present on another polynucleotide and the polynucleotides are comprised in one vector.

Preferably, in the composition according to the present invention, the Cas protein is encoded by a polynucleotide comprised in a vector and the guide-polynucleotide is encoded by or present on another polynucleotide comprised in another vector. Preferably, the vector encoding the Cas protein is a low copy vector and the vector encoding the guide-polynucleotide is a high copy vector. This allows differential expression of the Cas protein and the guide-polynucleotide; the Cas protein may e.g. be expressed in lower level than the guide-polynucleotide. Preferably herein, a low copy vector is a vector that is present in an amount of at most 10, 9, 8, 7, 6, 5, 4, 3, 2 or most preferably 1 copy per host cell. Preferably herein, a high copy vector is a vector that is present in an amount of more than 10, at least 15, at least 20, 25, 30, 35, 40, 45, 50, 55, 60, 70, 80, 90, or at least 100 copies per host cell. Examples of low copy vectors are yeast replicating plasmids or yeast centromeric plasmids. An example of a high copy vector is a yeast episomal plasmid comprising the 2μ (also known as 2mu or 2 micron) origin of replication.

The invention thus provides for the possibilities that the guide-polynucleotide and the Cas protein are provided as such, or that they are encoded on or present on a vector. In the latter case, the encoding polynucleotides may each be on a separate vector or may both be on a single vector. The present invention, as depicted elsewhere herein, also provides for an exogenous polynucleotide, also referred to as a donor polynucleotide, a donor DNA when the polynucleotide is a DNA, or repair template, that upon cleavage of the target-polynucleotide by the CRISPR-Cas complex recombines with the target-polynucleotide, resulting in a modified target-polynucleotide. Such exogenous polynucleotide is herein referred to as an exogenous polynucleotide according to the present invention and may be single-stranded or double-stranded. Accordingly, a composition according to the present invention may further comprise an exogenous polynucleotide according to the present invention; a composition according to the invention may comprise one or more distinct exogenous polynucleotides. Such one or more distinct exogenous polynucleotides may encode different expression products or may encode identical expression products while a part of the exogenous polynucleotide has sequence identity to a part of the target-polynucleotide. In an embodiment, the composition according to the invention comprises one or more distinct exogenous polynucleotides, said exogenous polynucleotide comprise one or more regions of sequence identity to the target polynucleotide to allow, upon cleavage of the target-polynucleotide by the CRISPR-Cas complex, homologous recombination with the cleaved target-polynucleotide, resulting in a modified target-polynucleotide. Such compositions according to the invention allow for a multiplex CRISPR-CAS system according to the invention as referred to elsewhere herein. In an embodiment, in a composition according to the invention where at least two distinct exogenous polynucleotides are present that upon cleavage of the target-polynucleotide by the CRISPR-Cas complex recombine with the target-polynucleotides, resulting in a modified target-polynucleotide, said at least two distinct exogenous polynucleotides may comprise sequence identity with each other such that recombination of said distinct exogenous polynucleotides is facilitated, wherein the recombination preferably is in vivo recombination in the host cell. In an embodiment, in the composition according to the invention comprising at least two distinct exogenous polynucleotides, each of said at least two distinct exogenous polynucleotides comprise at least one region of sequence identity with another exogenous polynucleotide and optionally with the target polynucleotide, to allow upon cleavage of the target-polynucleotide by the CRISPR-Cas complex, homologous recombination of said at least two distinct exogenous polynucleotides with one another and with the cleaved target-polynucleotide, resulting in a modified target-polynucleotide, wherein the recombination preferably is in vivo recombination in the host cell. Such compositions according to the invention allow for a singleplex CRISPR-Cas system according to the invention as described elsewhere herein and is exemplified, but not limited to, the procedure depicted in FIGS. 23 and 24. In a variant embodiment, an additional polynucleotide is present that has sequence identity with the exogenous and distinct polynucleotides such that recombination of the exogenous and distinct polynucleotides is facilitated, and wherein the recombination preferably is in vivo recombination in the host cell. In this variant embodiment, the additional polynucleotide or polynucleotides may have sequence identity with only the exogenous polynucleotides such that a complex of these can be formed. Alternatively, or in combination, an additional polynucleotide or polynucleotides may have sequence identity with an exogenous polynucleotide as well as sequence identity to a part of the target-polynucleotide such that the exogenous polynucleotide or complex of exogenous polynucleotides can be introduced into the target polynucleotide. Such is exemplified, but not limited to, the procedure depicted in FIG. 29.

The exogenous polynucleotide according to the present invention may be present on a vector or may be present as such, may be encoded by another polynucleotide or may be operably linked to the guide-polynucleotide and may have sequence identity to a part of the target-polynucleotide upstream of the PAM associated with the guide-sequence (i.e. on the 5' side of the PAM) or may have sequence identity to a part of the target-polynucleotide downstream of the PAM associated with the guide-sequence (i.e. on the 5' side of the PAM). The vector may be a separate vector for the exogenous polynucleotide. A vector carrying an exogenous polynucleotide may be any vector described herein below. The exogenous polynucleotide may be present on a vector that comprises a polynucleotide encoding a Cas protein according to the present invention and/or comprising a guide-polynucleotide or a polynucleotide encoding a guide-polynucleotide according to the present invention. Accordingly, in an embodiment, the present invention provides for a composition according to the present invention wherein a polynucleotide encoding a Cas protein according to the present invention, a guide-polynucleotide or a polynucleotide encoding a guide-polynucleotide according to the present invention are present on a single vector, which may further comprise any elements necessary for expressing the encoded products such as promoter and terminator elements. Such single (all-in-one) vector has the advantage that all components necessary for a CRISPR-Cas system are present together; in addition, a single transformation event, optionally in combination with a donor polynucleotide, suffices to introduce the components into a host cell. A preferred example of an all-in-one vector is depicted in examples 1-7 and FIGS. 1-6, 10 and 14 herein. In an embodiment, there is provided a composition according to the present invention wherein a Cas protein according to the present invention is encoded by a polynucleotide which is present on a vector and a guide-polynucleotide according to the present invention is present as such (e.g. as a PCR fragment, a restriction fragment or a synthetic fragment), the guide-polynucleotide may be operably linked to an exogenous polynucleotide according to the present invention, wherein the guide-polynucleotide and/or the operably linked exogenous polynucleotide has sequence identity with the vector such that it allows in vivo (homologous) recombination in the host cell of the guide-polynucleotide and/or the operably linked exogenous polynucleotide with the vector. Preferably, the in vivo recombination yields a second vector comprising the guide-polynucleotide and/or the operably linked exogenous polynucleotide. In case a guide-polynucleotide and an exogenous polynucleotide are operably linked and the guide-polynucleotide has sequence identity with the vector such as described here above, the exogenous polynucleotide is liberated when the guide-polynucleotide recombined with the vector. For the purposes described here above, the vector may be digested with a proper restriction enzyme (such as SapI) such that in vivo recombination is facilitated between the digested vector and the guide-polynucleotide and/or the operably linked exogenous polynucleotide. This embodiment enhances efficiency since it obviates the need for a vector-insert assembly step. These embodiments envisage that multiple distinct guide-polynucleotides can be used, or multiple distinct guide-polynucleotides operably linked to multiple distinct exogenous polynucleotides can be used, i.e. a library of guide-polynucleotides or guide-polynucleotides operably linked to multiple distinct exogenous polynucleotides. Such multiplex CRISPR-Cas system can conveniently be used for introduction of a donor polynucleotide sequence, deletion of a polynucleotide and polynucleotide library insertion into the genome of a host cell.

In the context of all embodiments of the present invention, a vector may be any vector (e.g., a plasmid or virus), which can conveniently be subjected to recombinant DNA procedures and can mediate expression of a polynucleotide according to the invention. The choice of the vector will typically depend on the compatibility of the vector with the host cell into which the vector is to be introduced. Preferred vectors are the vectors used in the examples herein. A vector may be a linear polynucleotide or a linear or closed circular plasmid. A vector may be an autonomously replicating vector, i.e., a vector, which exists as an extra-chromosomal entity, the replication of which is independent of chromosomal replication, e.g., a plasmid, an extra-chromosomal element, a mini-chromosome, or an artificial chromosome.

Preferably, in the composition according to the present invention, at least one vector is an autonomously replicating vector, or any autonomously replicating vector suitable to be used in a yeast host cell.

A vector may be one which, when introduced into the host cell, becomes integrated into the genome and replicated together with the chromosome(s) into which it has been integrated. An integrative vector may integrate at random or at a predetermined target locus in a chromosome of the host cell. A preferred integrative vector comprises a DNA fragment, which is homologous to a DNA sequence in a predetermined target locus in the genome of the host cell for targeting the integration of the vector to this predetermined locus. In order to promote targeted integration, a vector is preferably linearized prior to transformation of the cell. Linearization is preferably performed such that at least one but preferably either end of the vector is flanked by sequences homologous to the target locus. The length of the homologous sequences flanking the target locus is preferably at least 30 bp, preferably at least 50 bp, preferably at least 0.1 kb, even preferably at least 0.2 kb, more preferably at least 0.5 kb, even more preferably at least 1 kb, most preferably at least 2 kb. Preferably, the efficiency of targeted integration into the genome of the host cell, i.e. integration in a predetermined target locus, is increased by augmented homologous recombination abilities of the host cell. The homologous flanking DNA sequences in the vector (which are homologous to the target locus) may be derived from a highly expressed locus, meaning that they are derived from a gene, which is capable of high expression level in the host cell. A gene capable of high expression level, i.e. a highly expressed gene, is herein defined as a gene whose mRNA can make up at least 0.5% (w/w) of the total cellular mRNA, e.g. under induced conditions, or alternatively, a gene whose gene product can make up at least 1% (w/w) of the total cellular protein, or, in case of a secreted gene product, can be secreted to a level of at least 0.1 g/l (e.g. as described in EP 357 127 B1).

More than one copy of a polynucleotide according to the present invention may be inserted into the microbial host cell to mediate production of the product encoded by said polynucleotide. This can be done, preferably by integrating multiple copies of the polynucleotide into the genome of the host cell, more preferably by targeting the integration of the polynucleotide at one of the highly expressed loci defined in the former paragraph. Alternatively, integration of multiple copies can be achieved by including an amplifiable selectable marker gene with a polynucleotide according to the present invention, such that cells containing amplified copies of the selectable marker gene (and thereby additional copies of the nucleic acid sequence) can be selected for by cultivating the cells in the presence of the appropriate selectable agent. To increase the number of copies of a polynucleotide according the present invention even more, the technique of gene conversion as described in WO98/46772 may be used.

When a polynucleotide according to the present invention encoding a Cas protein according to the present invention and/or a guide-polynucleotide according to the present invention is integrated into the genome of the host cell, it may be desirable to excise the polynucleotide from the genome, e.g. when the desired genome editing has taken place. The excision of a polynucleotide can be performed by any means known to the person skilled in art; one preferred means is using Amds as a selection marker and counter-selecting with e.g. fluoroacetamide to excise the polynucleotide from the genome such as described in EP0635574. Another means for excision would be to use the well-known Cre/lox system; the polynucleotide sequence encoding the Cas-protein according to the present invention may e.g. be flanked by lox66/71 or loxP/loxP. A further means for excision would be to the use the CRISPR-Cas system according to the present invention, such as e.g. depicted in example 5 herein.

A vector according to the present invention may be a single vector or plasmid or a vector system comprising two or more vectors or plasmids, which together contain the polynucleotides according to the present invention to be introduced into the host cell host cell.

A vector according to the present invention may contain one or more selectable markers, which permit easy selection of transformed cells. In an embodiment, in a composition according to the invention, one or more or all vectors comprise a selectable marker, preferably each vector comprising a distinct selectable marker. A selectable marker is a gene the product of which provides for biocide or viral resistance, resistance to heavy metals, prototrophy to auxotrophs, and the like. The selectable marker may be introduced into the cell on the vector as an expression cassette or may be introduced on a separate vector.

A selectable marker for use in a yeast host cell may be selected from the group including, but not limited to, amdS (acetamidase), argB (ornithine carbamoyltransferase), bar (phosphinothricinacetyltransferase), bleA (phleomycin binding), hygB (hygromycinphosphotransferase), niaD (nitrate reductase), pyrG (orotidine-5'-phosphate decarboxylase), sC (sulfate adenyltransferase), NAT or NTC (Nourseothricin) and trpC (anthranilate synthase), KanMX (resistance to G418/geneticin; the selection marker kanMX is a hybrid gene consisting of a bacterial aminoglycoside phosphotransferase (kanr from transposon Tn903) under control of the strong TEF promoter from *Ashbya gossypii*; mammalian cells, yeast, and other eukaryotes acquire resistance to geneticin (=G418, an aminoglycoside antibiotic similar to kanamycin) when transformed with a kanMX marker; in yeast, the kanMX marker avoids the requirement of auxotrophic markers; in addition, the kanMX marker renders *E. coli* resistant to kanamycin.) as well as equivalents from other species.

Markers which can be used in a prokaryotic host cell include ATP synthetase, subunit 9 (oliC), orotidine-5'-phosphatedecarboxylase (pvrA), the ampicillin resistance gene (*E. coli*), resistance genes for neomycin, kanamycin, tetracycline, spectinomycin, erythromycin, chloramphenicol, phleomycin (*Bacillus*) and the *E. coli* uidA gene, coding for β-glucuronidase (GUS). Vectors may be used in vitro, for example for the in vitro production of RNA in an in vitro transcription system or used to transfect or transform a host cell.

Versatile marker genes that can be used for transformation of most yeasts such as acetamidase genes or cDNAs (the amdS, niaD, facA genes or cDNAs from *A. nidulans, A. oryzae* or *A. niger*), or genes providing resistance to antibiotics like G418, hygromycin, bleomycin, kanamycin, methotrexate, phleomycin orbenomyl resistance (benA). Alternatively, specific selection markers can be used such as auxotrophic markers which require corresponding mutant host strains: e. g. D-alanine racemase (from *Bacillus*), URA3 (from *S. cerevisiae* or analogous genes from other yeasts), pyrG or pyrA (from *A. nidulans* or *A. niger*), argB (from *A. nidulans* or *A. niger*) or trpC. In a preferred embodiment the selection marker is deleted from the transformed host cell after introduction of the expression construct so as to obtain transformed host cells capable of producing the polypeptide which are free of selection marker genes.

The procedures used to ligate elements described above to construct a vector according to the present invention are well known to one skilled in the art (see, e.g. Sambrook & Russell, *Molecular Cloning: A Laboratory Manual*, 3rd Ed., CSHL Press, Cold Spring Harbor, N.Y., 2001; and Ausubel et al., *Current Protocols in Molecular Biology*, Wiley Inter-Science, NY, 1995).

A Cas protein in the context of all embodiments of the present invention refers to any Cas protein suitable for the purpose of the invention. A Cas protein may comprise enzymatic activity or may not comprise enzymatic activity. Non-limiting examples of Cas proteins include Cas1, Cas1 B, Cas2, Cas3, Cas4, Cas5, Cas6, Cas7, Cas8, Cas9 (also known as Csn1 and Csx12), Cas10, Csy1, Csy2, Csy3, Cse1, Cse2, Cscl, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, Csf3, Csf4, homologs thereof or modified versions thereof. These Cas proteins are known to the person skilled in the art; for example, the amino acid sequence of *S. pyogenes* Cas9 protein may be found in the SwissProt database under accession number Q99ZW2. Preferably, an unmodified Cas protein according to the present invention has DNA cleavage activity, such as e.g. Cas9. Preferably, a Cas protein according to the present invention is Cas9, and may be Cas9 from *S. pyogenes* or *S. pneumoniae*. Preferably, a Cas protein according to the present invention directs cleavage of one or both polynucleotide strands at the location of the target-polynucleotide, such as within the target-polynucleotide and/or within the reverse complement of the target-polynucleotide. At the location of the target-polynucleotide is herein defined as within about 1, 2, 3, 4, 5, 6, 7, 8, 9, 10, 15, 20, 25, 50, 100, 200, 500, or more nucleotides from the first or last nucleotide of a target-polynucleotide; more preferably, within 1, 2, 3, 4, 5, 6, 7, 8, 9, 10, 15, 20, 25, 50, 100, 200, 500, or more nucleotides from the first or last nucleotide of a target-polynucleotide; even more preferably, within 1, 2, 3, 4, 5, 6, 7, 8, 9, 10, 15, 20, 25, 50 nucleotides from the first or last nucleotide of a target-polynucleotide. Accordingly, a Cas protein according to the present invention preferably directs cleavage of one or both polynucleotide strands within about 1, 2, 3, 4, 5, 6, 7, 8, 9, 10, 15, 20, 25, 50, 100, 200, 500, or more nucleotides from the first or last nucleotide of a target-polynucleotide; more preferably, within 1, 2, 3, 4, 5, 6, 7, 8, 9, 10, 15, 20, 25, 50, 100, 200, 500, or more nucleotides from the first or last nucleotide of a target-polynucleotide; even more preferably, within 1, 2, 3, 4, 5, 6, 7, 8, 9, 10, 15, 20, 25, 50 nucleotides from the first or last nucleotide of a target-polynucleotide. Typically, a target-polynucleotide according to the present invention is associated with a PAM sequence (defined elsewhere herein) and the PAM sequence is preferably immediately downstream (3') of the target-sequence; the formation of the CRISPR-Cas complex typically results in cleavage of one or both polynucleotide strands 3 base pairs upstream (5') of the PAM sequence.

Preferably, a Cas protein in a composition according to the present invention has activity for directing cleavage of both polynucleotide strands at the location of the target-polynucleotide. Cas nuclease activity is typically performed by two separate catalytic domains, namely RuvC and HNH. Each domain cuts one polynucleotide strand each domain can be inactivated by a single point mutation. A Cas protein according to the present invention may thus conveniently be mutated with respect to a corresponding wild-type Cas protein such that the mutated Cas protein has altered nuclease activity and lacks the ability to cleave one or both strands of a target-polynucleotide. In the embodiment of the invention, altered nuclease activity of a Cas protein according to the invention is preferably determined in view of the wild-type Cas protein and is preferably determined under identical or substantially identical conditions; the person skilled in the art knows how to determine nuclease activity of a Cas protein. For example, an aspartate-to-alanine substitution (D10A) in the RuvC I catalytic domain of Cas9 from *S. pyogenes* converts Cas9 from a nuclease that cleaves both strands to a nickase, which is herein defined as a Cas protein that cleaves a single strand of a target-polynucleotide. Other examples of mutations that render Cas9 into a nickase include, but are not limited to H840A, N854A, and N863A. In the context of the present invention, a Cas protein having nickase activity may be used for genome editing via homologous recombination, preferably the double nicking technique according to Ran et al., 2013. Accordingly, a preferred Cas protein according to the present invention comprises at least one mutation, such that the protein has altered nuclease activity compared to the corresponding wild-type Cas protein, preferably having activity to direct cleavage of a single polynucleotide strand at the location of the target-sequence. Such so-called nickase mutant can conveniently be used in duplex set-up, i.e. in a composition according to the present invention comprising a Cas protein nickase mutant with RuvC mutated and a Cas protein nickase mutant wherein NHN is mutated, such that the one Cas protein mutant nicks one strand of the polynucleotide target and the other Cas protein mutant nicks the other strand of the polynucleotide target. Depending on the two guide-polynucleotides used, the two different CRISPR-Cas complexes will effectively result in two single-strand nicks in the polynucleotide target; these nicks may be several nucleotides up to 5, 10, 20, 30 or more apart. Such double nicking method greatly enhances specificity of NEJH. Background information on double nicking can be found in e.g. Ran et al, 2013.

A Cas protein according to the present invention may comprise two or more mutated catalytic domains of Cas9, such as RuvC I, RuvC II and/or RuvC III to result in a mutated Cas9 substantially lacking all DNA cleavage activity. In some embodiments, a D10A mutation is combined with one or more of H840A, N854A, or N863A mutations to produce a Cas9 enzyme substantially lacking all DNA cleavage activity. Preferably, a Cas protein is considered to substantially lack all DNA cleavage activity when the DNA cleavage activity of the mutated enzyme is less than about 25%, 10%, 5%, 1%, 0.1%, 0.01%, or lower with respect to its non-mutated form. A Cas protein lacking substantially all enzyme activity can conveniently be used for gene silencing or down regulation of expression since the CRISPR-CAS complex will hamper transcription from the target-polynucleotide. Other mutations may be useful; where the Cas9 or other Cas protein is from a species other than *S. pyogenes*, mutations in corresponding amino acids may be made to achieve similar effects; the person skilled in the art knows how to identify these corresponding amino acids.

A Cas protein according to the present invention may be a fusion protein and comprise at least one heterologous functional domain, such domain preferably is a domain comprising FokI activity such as described by Aggarwal et al (Aggarwal, A. K.; Wah, D. A.; Hirsch, J. A.; Dorner, L. F.; Schildkraut, I. (1997). "Structure of the multimodular endonuclease FokI bound to DNA". Nature 388 (6637): 97-100). The enzyme FokI is naturally found in *Flavobacterium okeanokoites* and is a bacterial type IIS restriction endonuclease consisting of an N-terminal DNA-binding domain and a non-specific DNA cleavage domain at the C-terminal (Durai et al., 2005). When the FokI protein is bound to double stranded DNA via its DNA-binding domain at the 5'-GGATG-3':3'-CATCC-5' recognition site, the DNA cleavage domain is activated and cleaves, without further sequence specificity, the first strand 9 nucleotides downstream and the second strand 13 nucleotides upstream of the nearest nucleotide of the recognition site (Wah et al., 1998. Cas9-FokI fusions have been described inter alia in Guilinger et al., 2014; and in Tsai et al., 2014.

A Cas fusion protein according to the present invention may comprise 1, 2, 3, 4, 5, 6, 7, 8, 9, 10, or more domains in addition to the Cas protein. Examples of protein domains that may be fused to a Cas protein include, but are not limited to, epitope tags, reporter gene sequences, and protein domains having one or more of the following activities: methylase activity, demethylase activity, transcription activation activity, transcription repression activity, transcription release factor activity, historic modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A Cas protein may be fused to a gene sequence encoding a protein or a fragment of a protein that bind DNA molecules or bind other cellular molecules, including but not limited to, maltose binding protein (MBP), S-tag, Lex A DNA binding domain (DBD) fusions, GAL4 DNA binding domain fusions, and herpes simplex virus (HSV) BP 16 protein fusions. Additional domains that may form part of a fusion protein comprising a CRISPR enzyme are described in US20110059502. A tagged Cas protein may be used to identify the location of a target-polynucleotide. A preferred Cas fusion protein according to the present invention comprises a FokI domain as defined here above.

A preferred Cas protein according to the present invention comprises a nuclear localization sequence, preferably a heterologous nuclear localization sequence. Such nuclear localization sequence is also referred as a nuclear localization signal. Preferably, such nuclear localization signal confers to the CRISPR-Cas complex sufficient strength to drive accumulation of said CRISPR-Cas complex in a detectable amount in the nucleus of a host cell. Without wishing to be bound by theory, it is believed that a nuclear localization sequence is not necessary for CRISPR-Cas activity in a host cell, but that including such sequences enhances activity of the system, especially as to targeting nucleic acid molecules into the nucleus. Such nuclear localization sequence is preferably present in the Cas protein, but may also be present anywhere else such that targeting of the CRISPR-Cas system to the nucleus is facilitated. A preferred nuclear localization sequence is the SV40 nuclear localization sequence.

In a composition and in any other embodiment according to the present invention a Cas protein encoding polynucleotide is preferably codon optimized for the host cell it is to be expressed in, more preferably the Cas protein encoding polynucleotide is codon pair optimized. In general, codon optimization refers to a process of modifying a nucleic acid sequence for enhanced expression in a host cell of interest by replacing at least one codon (e.g. more than 1, 2, 3, 4, 5, 10, 15, 20, 25, 50, or more codons) of a native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database", and these tables can be adapted in a number of ways. See e.g. Nakamura, Y., et al., 2000. Computer algorithms for codon optimizing a particular sequence for expression in a particular host cell are also available, such as Gene Forge (Aptagen; Jacobus, Pa.), are also available. Preferably, one or more codons (e.g. 1, 2, 3, 4, 5, 10, 15, 20, 25, 50, or more, or all codons) in a sequence encoding a Cas protein correspond to the most frequently used codon for a particular amino acid. Preferred methods for codon optimization are described in WO2006/077258 and WO2008/000632). WO2008/000632 addresses codon-pair optimization. Codon-pair optimization is a method wherein the nucleotide sequences encoding a polypeptide have been modified with respect to their codon-usage, in particular the codon-pairs that are used, to obtain improved expression of the nucleotide sequence encoding the polypeptide and/or improved production of the encoded polypeptide. Codon pairs are defined as a set of two subsequent triplets (codons) in a coding sequence. The amount of Cas protein in a source in a composition according to the present invention may vary and may be optimized for optimal performance. It may be convenient to avoid too high levels of Cas protein in a host cell since high levels of Cas protein may be toxic to the host cell, even without a guide-polynucleotide present (see e.g. Ryan et al 2014 and Jacobs et al., 2014). A person skilled in the art knows how to regulate expression levels, such as by choosing a weaker promoter, repressible promoter or inducible promoter for expression of a Cas protein. Examples of promoters suitable for expression of a protein are depicted elsewhere herein.

In a composition according to the present invention wherein a guide-polynucleotide according to the present invention is encoded by a polynucleotide, expression of the guide-polynucleotide may be facilitated by a promoter operably linked to the encoding polynucleotide. Such promoter may be any suitable promoter known to the person skilled in the art. Several types of promoters can be used. It may be convenient to use an RNA polymerase III promoter or an RNA polymerase II promoter. Background information on RNA polymerase III and its promoters can be found e.g. in Marck et al., 2006. In some cases, such as in S. cerevisiae, S. pombe, RNA polymerase III promoters include promoter elements in the transcribed region. Accordingly, it may be convenient to use an RNA polymerase II promoter; these are known to the person skilled in the art and reviewed in e.g. Kornberg 1999. However, transcripts from an RNA II polymerase often have complex transcription terminators and transcripts are polyadenylated; this may hamper with the requirements of the guide-polynucleotide because both its 5' and 3' ends need to be precisely defined in order to achieve the required secondary structure to produce a functional CRISPR-Cas system. These drawbacks can however be circumvented. In case an RNA polymerase II promoter is used, the polynucleotide encoding the guide-polynucleotide may also encode self-processing ribozymes and may be operably linked to an RNA polymerase II promoter; as such the polynucleotide encodes a pre-guide-polynucleotide comprising the guide-polynucleotide and self-processing ribozymes, wherein, when transcribed, the guide-polynucleotide is released by the self-processing ribozymes from the pre-guide-polynucleotide transcript. Background information on such constructs can be found in e.g. Gao et al, 2014 et al.

Preferably, in a composition according to the present invention wherein the guide-polynucleotide is encoded by a polynucleotide, said polynucleotide is operably linked to an H1 RNA polymerase III promoter, preferably a human H1 RNA polymerase III promoter. Preferably, in a composition according to the present invention wherein the guide-polynucleotide is encoded by a polynucleotide, said polynucleotide is operably linked to a U6 RNA polymerase III promoter, preferably a human U6 RNA polymerase III promoter. Preferably, in a composition according to the present invention wherein the guide-polynucleotide is encoded by a polynucleotide, said polynucleotide is operably linked to an SNR52p RNA polymerase III promoter, preferably a yeast SNR52p RNA polymerase III promoter. Such promoter is preferably used when the host is a yeast host cell, such as a *Saccharomyces* or a *Kluyveromyces*.

Preferably, in a composition according to the present invention wherein the guide-polynucleotide is encoded by a polynucleotide, said polynucleotide is operably linked to an RNA polymerase II promoter and encodes a pre-guide-polynucleotide comprising the guide-polynucleotide and self-processing ribozymes, wherein, when transcribed, the guide-polynucleotide is released by the self-processing ribozymes from the pre-guide-polynucleotide transcript. Conveniently, multiple pre-guide-polynucleotides and multiple self-processing ribozymes may be encoded by a single polynucleotide, operably linked to one or more RNA polymerase II promoters.

The composition according to the first aspect of the present invention can conveniently be used to modulate expression of a polynucleotide in a host cell. Accordingly, in a second aspect, the present invention provides a method of modulating expression of a polynucleotide in a host cell, comprising contacting a host cell with the composition according to the first aspect of the invention, wherein the guide-polynucleotide directs binding of the Cas protein at the target-polynucleotide in the host cell to form a CRISPR-Cas complex.

The term "expression" in the context of the present invention is herein defined as the process by which a polynucleotide is transcribed from a polynucleotide template (e.g. a DNA template polynucleotide is transcribed into an mRNA polynucleotide transcript or other RNA transcript) and/or the process by which an mRNA transcript is subsequently translated into peptides, polypeptides, or proteins. Transcripts and encoded polypeptides may be collectively referred to as "gene product". If the polynucleotide transcript is derived from a genomic template DNA, expression may include splicing of the mRNA transcript in a host cell. The term "modulating expression" refers herein to increased or reduced expression compared to a parent host cell wherein expressing is not modulated when assayed using the same conditions. Reduced expression may be a reduced amount of transcript such as mRNA and/or a reduced amount of translation product such as a polypeptide. It follows that increased expression may be an enhanced amount of transcript such as mRNA and/or an enhanced amount of translation product such as a polypeptide. Preferably, the CRISPR-Cas complex cleaves one or both polynucleotide strands at the location of the target-polynucleotide, resulting in modulated expression of the gene product. The CRISPR-Cas complex may also have altered nuclease activity and substantially lack the ability to cleave one or both strands of a target-polynucleotide; in such case, expression is modulated by the binding of the complex to the target-polynucleotide. A Cas protein lacking substantially all enzyme activity can conveniently be used for gene silencing or down regulation of expression since the CRISPR-Cas complex will hamper transcription from the target-polynucleotide. Alternatively, a Cas protein can be modified into a transcription factor for programmable transcriptional activation or silencing of a gene of interest (Larson, et al., 2013).

A composition according to the first aspect of the present invention can conveniently be used for the deletion of polynucleotide. In an embodiment, when the composition according to the first aspect of the present invention comprises a source of at least one or two guide-polynucleotides and/or a source of at least at least one Cas protein, at least one CRISPR-Cas complex or two different CRISPR-Cas complexes are formed that cleave one or both polynucleotide strands at one location or at different locations of the target-polynucleotide, resulting in deletion of a polynucleotide fragment from the target-polynucleotide. Preferably, such composition according to the present invention comprising at least one or two guide-polynucleotides and/or a source of at least at least one Cas protein, additionally comprises an exogenous polynucleotide as defined herein below that is at least partly complementary to the at least one or two target-polynucleotides targeted by the guide-polynucleotide(s). Such polynucleotide fragment to be deleted or deleted fragment may be several nucleotides in length up to a few thousand nucleotides in length, an entire gene may be deleted or a cluster of genes may be deleted. Accordingly, the present invention provides for a method of modulating expression of a polynucleotide in a host cell, wherein a polynucleotide fragment is deleted from a target-polynucleotide. A preferred method is depicted in example 5 herein.

In an embodiment, the method of modulating expression comprises cleavage of one or both polynucleotide strands at at least one location of the target-polynucleotide followed by modification of the target-polynucleotide by homologous recombination with an exogenous polynucleotide. In such case, the composition according to the first aspect of the present invention preferably further comprises such exogenous polynucleotide. Such modification may result in insertion, deletion or substitution of at least one nucleotide in the target-polynucleotide, wherein the insertion or substitution nucleotide may originate from the exogenous polynucleotide. A modification can also be made when the exogenous polynucleotide is a non-integrating entity such as described in Dong et al., and Beetham et al.; in this case the target-polynucleotide is modified but no nucleotide of the exogenous polynucleotide is introduced into the target-polynucleotide. Consequently, the resulting host is a non-recombinant host cell when the Cas-protein according to the invention is transformed as a protein. The exogenous polynucleotide may be any polynucleotide of interest such as a polynucleotide encoding a compound of interest as defined herein below, or a part of such polynucleotide or a variant thereof. Such exogenous polynucleotide is herein referred to as an exogenous polynucleotide according to the present invention and may single-stranded or double-stranded.

Various applications can be considered by the person skilled in the art for the compositions and methods according to the present invention. A polynucleotide (or gene) in a genome may be modified, edited or disrupted using compositions and methods according to the present invention. E.g. when a fully active Cas protein is used that cuts in both strands of the target-polynucleotide and when no exogenous polynucleotide is present as a suitable repair template, the double strand break is repaired by non-homologous end joining repair (NHEJ). During NHEJ insertions and/or deletions (which may be construed as substitution in some cases) of one or several nucleotides may occur, these are randomly inserted or deleted at the repair site; this is characteristic for NHEJ. Such insertions and/or deletions may impact the reading frame of the coding sequence, resulting amino acid changes in the gene product or even a truncated protein in case of genesis of a (premature) stop codon or alteration of a splice site.

A polynucleotide (or gene) in a genome may be modified, edited or disrupted using compositions and methods according to the present invention using homologous end joining repair (HEJ), also known as homology-directed repair (HDR), when an exogenous polynucleotide is present as repair template. E.g. when an exogenous polynucleotide having sequence identity to the target-polynucleotide (i.e. upstream (5') and downstream (3') of the double strand break) is present together with a CRISPR-Cas system according to the present invention, HDR will introduce (or actually reproduce) the corresponding nucleotides of the exogenous polynucleotide at the double strand break in the target-polynucleotide. Preferably, an exogenous polynucleotide according to the present invention does not contain the target sequence itself followed by a functional PAM sequence to avoid the risk of the exogenous polynucleotide itself or the modified target-polynucleotide being (re)cut by the CRISPR-CAS system.

In the embodiments of the present invention, when a CRISPR-Cas system according to the present invention comprises an exogenous polynucleotide (donor polynucleotide, donor DNA, repair template), the CRISPR-Cas system according to the present invention preferably comprises two or more guide-polynucleotides encoded by or present on one or more separate polynucleotides or vectors, and two or more exogenous polynucleotides are provided together with said CRISPR-Cas system enabling the formation of two or more CRISPR-CAS complexes. In a method according to the present invention, such CRISPR-Cas systems according to the present invention can conveniently be used to modulate expression at two or more target-polynucleotides, i.e. a method to target multiple target sites. Such CRISPR-Cas system according to the present invention will by chance form one, two or more CRISPR-CAS complexes at one or more target-polynucleotides. Such method can be used to generate one or more insertions, deletions, substitutions, optionally in combination with the one or more exogenous polynucleotides, in the genome of the host cell, or to modulate expression of genes via the formed CRISPR-CAS complexes.

In the embodiments of the present invention when a CRISPR-Cas system according to the present invention comprises an exogenous polynucleotide (donor polynucleotide, repair template), the exogenous polynucleotide and the guide-polynucleotide may be encoded by or present on a single polynucleotide. This enables synthesis of two or more of such combination polynucleotides and even library synthesis of such combination polynucleotides. Such library can be provided as a pool and be used to make a library of vectors and/or polynucleotides where the guide-polynucleotide and the exogenous polynucleotide are together encoded by or present on one polynucleotide. Such pool enables the use of a CRISPR-Cas system according to the present invention in a library-like multiplex system. In such CRISPR-Cas system according to the present invention, the exogenous polynucleotide and the guide-polynucleotide may be directly connected or may be separated by a linker polynucleotide.

In an embodiment, the guide-polynucleotide and the exogenous polynucleotide are connected by a linker polynucleotide that encodes for or represents the right flank of the guide-polynucleotide encoding or representing the gRNA 3' sequence and terminator, or a linker polynucleotide that encodes for or represents the left flank of the guide-polynucleotide encoding or representing the gRNA 5' sequence and promoter. This enables synthesis of two or more of such combination polynucleotides and even library synthesis of such combination polynucleotides. Such combination polynucleotides can be further processed to form a combination polynucleotide with one or more functional guide-polynucleotide(s) (containing a promoter and terminator).

In an embodiment, the guide-polynucleotide and the exogenous polynucleotide are connected by a linker polynucleotide that encodes for or represents the right flank of the guide-polynucleotide encoding or representing the gRNA 3' sequence and terminator and the polynucleotide target for said guide-polynucleotide, or a linker polynucleotide that encodes for or represents the polynucleotide target for said guide-polynucleotide and the left flank of the guide-polynucleotide encoding or representing the gRNA 5' sequence and promoter, where in vivo a CRISPR-Cas system can be formed at the combination polynucleotide to cleave the combination polynucleotide.

In an embodiment, one or more combination polynucleotides according to the present invention can be recombined (e.g. via direct cloning or in vivo recombination) with one or more vectors encoding Cas protein according to the present invention. One or more of such recombined vectors enable the formation of one or more CRISPR-CAS complexes. The host cell according to this aspect of the present invention may be any host cell as defined herein. A preferred host cell is a modified host cell wherein expression of a component associated with non-homologous end joining (NHEJ) is altered compared to the corresponding wild-type host cell; preferably expression of the component associated with NHEJ is lowered. Preferred components associated with NHEJ are the yeast Ku70 and Ku80 and their respective orthologs in preferred non-mammalian host cells according to the present invention. Another preferred component associated with NHEJ is the yeast LIG4 and its respective orthologs in preferred non-mammalian host cells according to the present invention.

In a method according to this aspect of the present invention, a preferred host cell comprises a polynucleotide encoding a compound of interest as defined elsewhere herein. In a method according to this aspect of the present invention, the host cell may be a recombinant host cell or may be a non-recombinant host cell.

A method of modulating expression of a polynucleotide in a host cell according to this aspect of the present invention, results in a modified host cell that preferably comprises components of the composition according to the first aspect of the present invention. Accordingly, in a third aspect the present invention provides for a host cell comprising a composition according to the first aspect of the present invention. Such host cell may be any host cell as defined herein and may further comprise a polynucleotide encoding a compound of interest as defined elsewhere herein.

In a fourth aspect, the present invention provides a method of producing a host cell, comprising contacting a host cell with the composition according to the first aspect of the present invention, wherein the guide-polynucleotide directs binding of the Cas protein at the target-polynucleotide in the host cell to form a CRISPR-Cas complex. In an embodiment, the contacting with the composition according to the first aspect of the invention may be performed in two steps, wherein the host cell is first contacted with a source of a Cas protein according to the invention and subsequently the host cell is contacted with a source of a guide-polynucleotide according to the invention and optionally an exogenous polynucleotide according to the invention. A host cell in this embodiment of the present invention may be any type of host cell as defined herein and may comprise a polynucleotide encoding a compound of interest as defined elsewhere herein. A preferred method of producing a host cell according to the present invention comprises a step to produce an offspring host cell, wherein in said offspring host cell no components of a CRISPR-Cas system according to the present invention are present anymore. A further preferred host cell is a modified host cell wherein expression of a component associated with NHEJ as depicted here above is altered compared to the corresponding wild-type host cell; preferably expression of the component associated with NHEJ is lowered.

The composition according to the first aspect of the present invention may be any such composition as defined herein. Contacting a host cell with a composition according to the present invention may be performed by any means known to the person skilled in the art. A host cell according to the present invention may simply be brought into a solution comprising a composition according to the present invention. Specific means of delivering a composition according to the present invention into a host cell may be used. The person skilled in the art is aware of such methods (see e.g. Sambrook & Russell; Ausubel, supra)., which include but are not limited to electroporation methods, particle bombardment or microprojectile bombardment, protoplast methods and *Agrobacterium* mediated transformation (AMT Yeast may be transformed using any method known in the art such as the procedures described by Becker and Guarente, In Abelson, J. N. and Simon, 1983; Hinnen et al., 1978, and Gietz R D, Woods R A. 2002.

Preferably, the CRISPR-Cas complex cleaves one or both polynucleotide strands at the location of the target-polynucleotide, resulting in modulated expression of the gene product. The CRISPR-Cas complex may also have altered nuclease activity and lack the ability to cleave one or both strands of a target-polynucleotide; in such case, expression is modulated by the binding of the complex to the target-polynucleotide.

In an embodiment, when the composition according to the first aspect of the present invention comprises a source of at least one or two guide-polynucleotides and/or a source of at least one Cas protein, at least one CRISPR-Cas complex or two different CRISPR-CAS complexes are formed that cleave one or both polynucleotide strands at one location or at different locations of the target-polynucleotide, resulting in deletion of a polynucleotide fragment from the target-polynucleotide. Preferably, such composition according to the present invention comprising at least one or two guide-polynucleotides and/or a source of at least at least one Cas protein, additionally comprises an exogenous polynucleotide as defined herein below that is at least partly complementary to the at least one or two target-polynucleotides targeted by the guide-polynucleotide(s). Such polynucleotide fragment to be deleted or deleted fragment may be from several nucleotides in length up to a few thousand nucleotides in length, an entire gene may be deleted or a cluster of genes may be deleted. Accordingly, the present invention provides for a method of modulating expression of a polynucleotide in a host cell, wherein a polynucleotide fragment is deleted from a target-polynucleotide.

In one embodiment a method of modulating expression of a polynucleotide in a host cell, wherein a polynucleotide fragments is deleted from a target-polynucleotide, comprises contacting a host cell with a composition as described herein, wherein the guide-polynucleotide directs binding of the Cas protein at the target-polynucleotide in the host cell to form a CRISPR-Cas complex. Preferably a method of modulating expression of a polynucleotide in a host cell, wherein a polynucleotide fragments is deleted from a target-polynucleotide, comprises contacting a host cell with a composition as described herein, wherein the guide-polynucleotide directs binding of the Cas protein at the target-polynucleotide in the host cell to form a CRISPR-Cas complex, wherein the host cell is a modified host cell deficient in a component associated with NHEJ. In another preferred embodiment a method of modulating expression of a polynucleotide in a host cell, wherein a polynucleotide fragments is deleted from a target-polynucleotide, comprises contacting a host cell with a composition as described herein, wherein the guide-polynucleotide directs binding of the Cas protein at the target-polynucleotide in the host cell to form a CRISPR-Cas complex, wherein the host cell is a modified host cell deficient in a component associated with NHEJ, wherein the composition as described herein does not comprise an exogenous or donor polynucleotide. In one preferred embodiment the component associated with NHEJ is a yeast Ku70 or a yeast Ku80 or a yeast LIG4 or its respective ortholog in the host cells according to the present invention.

Therefore the present invention relates in one embodiment to a method of modulating expression of a polynucleotide in a cell, wherein a polynucleotide fragment is deleted from a target-polynucleotide, comprising contacting a host cell with the composition as described herein but preferably not comprising a donor polynucleotide as defined herein, wherein the guide-polynucleotide directs binding of the Cas protein at the target-polynucleotide in the host cell to form a CRISPR-Cas complex, wherein the host cell is deficient in a component associated with NHEJ, preferably a yeast Ku70 or yeast Ku80 or a yeast LIG4 or its respective ortholog in the host cells.

Surprisingly it has been found that in a host cell deficient in a gene involved in NHEJ it is possible to obtain deletions in the host cell genome in a controlled way by using the CRISPR/CAS9 system when regions of homology are present at both sites of the intended cleavage site and wherein the composition as described herein does not comprise a donor DNA, in a method of modulating expression of a polynucleotide in a cell, wherein a polynucleotide fragment is deleted from a target-polynucleotide, as described herein. Therefore in one embodiment the invention relates to a method of modulating expression of a polynucleotide in a cell, wherein a polynucleotide fragment is deleted from a target-polynucleotide, comprising contacting a host cell with a non-naturally occurring or engineered composition comprising a source of a CRISPR-Cas system comprising a guide-polynucleotide and a Cas protein, wherein the guide-polynucleotide comprises a guide-sequence that essentially is the reverse complement of a target-polynucleotide in a host cell and the guide-polynucleotide can direct binding of the Cas protein at the target-polynucleotide in the host cell to form a CRISPR-Cas complex, wherein the guide-sequence is essentially the reverse complement of the (N)y part of a 5'-(N)yPAM-3' polynucleotide sequence target in the genome of the host cell, wherein y is an integer of 8-30, wherein PAM is a protospacer adjacent motif, wherein the host cell is a eukaryote, which eukaryote is a yeast, preferably a *Saccharomyces* or a *Kluyveromyces* and wherein PAM is preferably a sequence selected from the group consisting of 5'-XGG-3', 5'-XGGXG-3', 5'-XXAGAAW-3', 5'-XXXXGATT-3', 5'-XXAGAA-3', 5'-XAAAAC-3', wherein X can be any nucleotide or analog thereof, preferably X can be any nucleotide; and W is A or T herein but preferably not comprising a donor polynucleotide as defined herein, wherein the guide-polynucleotide directs binding of the Cas protein at the target-polynucleotide in the host cell to form a CRISPR-Cas complex, wherein the host cell is deficient in a component associated with NHEJ, preferably a yeast Ku70 or yeast Ku80 or a yeast LIG4 or its respective ortholog in the host cells, wherein the Cas protein has activity for directing cleavage of both polynucleotide strands at the location of the target-sequence and wherein the cleavage occurs in a region of the genome comprised between two homologous regions which upon cleavage by the Cas protein recombine with each other resulting in the deletion of a polynucleotide comprised between said regions.

Preferably the degree of homology between the two homologous regions is such to allow homologous recombination. Preferably the two homologous regions have at least 60%, 70%, 80%, 90%, 99% or 100% sequence identity over the whole length of the homologous regions. It has been surprisingly found that the length of homologous region can be very short even in filamentous fungi, wherein usually a length of at least 1 or several kb is necessary to allow homologous recombination. Therefore in a preferred embodiment the length of the homologous regions is preferably at most 1 kb, at most 0.5 kb, at most 100 bp, at most 50 bp, at most 40 bp, at most 30 bp, at most 20 bp, at most 10 bp.

Preferably the distance between the two homologous regions is at most 10 kb, at most 9, at most 8 kb, at most 7 kb, at most 6 kb, at most 5 kb, at most 4 kb, at most 3 kb, at most 2 kb, at most 1 kb, at most 0.5 kb, at most 100 bp, at most 50 bp, at most 40 bp, at most 30, 20, 10 kb.

In one aspect, the invention relates to a software algorithms able to identify PAM sites in the genome comprised between homology regions of about 7-20 bp in a neighbourhood of the PAM site to design a method to target one or more PAM sites and create deletion of polynucleotides without use of a donor DNA.

The above method can be used for efficient removal of polynucleotide sequences in a designed way. For example upon introducing a Cas9 expression cassette at the genomic DNA and after several rounds of modifications mediated by the CRISPR/CAS9 system, one can remove the CAS9 from the genome by the introduction of a gRNA targeting a site in the Cas9 expression cassette and wherein the Cas9 expression cassette is comprised between two homologous regions as defined above, preferably 100-bp long, more preferably 20-bp, 15-bp long or shorter and cleave out the Cas9 open reading frame or a large part of the expression cassette.

The above method can also be used for transient inactivation of a gene. E.g. one could for example make a gene, e.g. a Ku70 polynucleotide non-functional by inserting a polynucleotide sequence in the ORF of the Ku70 gene, comprising two homologous regions at its 5'-end and 3'-end respectively, wherein preferably the homologous regions are 100-bp, more preferably 20-bp, 15-bp long or shorter. The Ku70 gene can be made functional again using a CRISPR-Cas9 system without donor DNA as described above. In an embodiment, the method of modulating expression comprises cleavage of one or both polynucleotide strands at at least one location of the target-polynucleotide followed by modification of the target-polynucleotide by homologous recombination with an exogenous polynucleotide. In such case, the composition according to the first aspect of the present invention preferably further comprises such exogenous polynucleotide. Such modification may result in insertion, deletion or substitution of at least one nucleotide in the target-polynucleotide, wherein the insertion or substitution nucleotide may or may not originate from the exogenous polynucleotide. In one embodiment the exogenous polynucleotide comprises regions of homology with the target-polynucleotide. Preferably the degree of homology between these homologous regions is such to allow homologous recombination. Preferably the homologous regions have at least 60%, 70%, 80%, 90%, 99% or 100% sequence identity over the whole length of the homologous regions. In one embodiment, wherein the host cell is deficient in a component involve in NHEJ as defined herewith, the homologous regions are preferably at most 1 kb, at most 0.5 kb, at most 100 bp, at most 50 bp, at most 40 bp, at most 30 bp, at most 20 bp, at most 10 bp. A modification can also be made when the exogenous polynucleotide is a non-integrating entity; in this case the target-polynucleotide is modified but no nucleotide of the exogenous polynucleotide is introduced into the target-polynucleotide. Consequently, the resulting host is a non-recombinant host when the Cas-protein according to the present invention is transformed as a protein. In a method according to this aspect of the present invention, the host cell may thus be a recombinant host cell or may be a non-recombinant host cell. The exogenous polynucleotide may be any polynucleotide of interest such as a polynucleotide encoding a compound of interest as defined herein, or a part of such polynucleotide or a variant thereof.

In a fifth aspect, the present invention provides for a method for the production of a compound of interest, comprising culturing under conditions conducive to the compound of interest a host cell according to the third or fourth aspect of the present invention or a host cell obtained by a method according to the second aspect of the present invention, or a host cell obtainable by a method according to the fourth aspect of the present invention and optionally purifying or isolating the compound of interest.

A compound of interest in the context of all embodiments of the present invention may be any biological compound. The biological compound may be biomass or a biopolymer or a metabolite. The biological compound may be encoded by a single polynucleotide or a series of polynucleotides composing a biosynthetic or metabolic pathway or may be the direct result of the product of a single polynucleotide or products of a series of polynucleotides, the polynucleotide may be a gene, the series of polynucleotide may be a gene cluster. In all embodiments of the present invention, the single polynucleotide or series of polynucleotides encoding the biological compound of interest or the biosynthetic or metabolic pathway associated with the biological compound of interest, are preferred targets for the compositions and methods according to the present invention. The biological compound may be native to the host cell or heterologous to the host cell.

The term "heterologous biological compound" is defined herein as a biological compound which is not native to the cell; or a native biological compound in which structural modifications have been made to alter the native biological compound.

The term "biopolymer" is defined herein as a chain (or polymer) of identical, similar, or dissimilar subunits (monomers). The biopolymer may be any biopolymer. The biopolymer may for example be, but is not limited to, a nucleic acid, polyamine, polyol, polypeptide (or polyamide), or polysaccharide.

The biopolymer may be a polypeptide. The polypeptide may be any polypeptide having a biological activity of interest. The term "polypeptide" is not meant herein to refer to a specific length of the encoded product and, therefore, encompasses peptides, oligopeptides, and proteins. The term polypeptide refers to polymers of amino acids of any length. The polymer may be linear or branched, it may comprise modified amino acids, and it may be interrupted by non amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. Polypeptides further include naturally occurring allelic and engineered variations of the above-mentioned polypeptides and hybrid polypeptides. The polypeptide may be native or may be heterologous to the host cell. The polypeptide may be a collagen or gelatine, or a variant or hybrid thereof. The polypeptide may be an antibody or parts thereof, an antigen, a clotting factor, an enzyme, a hormone or a hormone variant, a receptor or parts thereof, a regulatory protein, a structural protein, a reporter, or a transport protein, protein involved in secretion process, protein involved in folding process, chaperone, peptide amino acid transporter, glycosylation factor, transcription factor, synthetic peptide or oligopeptide, intracellular protein. The intracellular protein may be an enzyme such as, a protease, ceramidases, epoxide hydrolase, aminopeptidase, acylases, aldolase, hydroxylase, aminopeptidase, lipase. The polypeptide may also be an enzyme secreted extracellularly. Such enzymes may belong to the groups of oxidoreductase, transferase, hydrolase, lyase, isomerase, ligase, catalase, cellulase, chitinase, cutinase, deoxyribonuclease, dextranase, esterase. The enzyme may be a carbohydrase, e.g. cellulases such as endoglucanases, β-glucanases, cellobiohydrolases or β-glucosidases, hemicellulases or pectinolytic enzymes such as xylanases, xylosidases, mannanases, galactanases, galactosidases, pectin methyl esterases, pectin lyases, pectate lyases, endo polygalacturonases, exopolygalacturonases rhamnogalacturonases, arabanases, arabinofuranosidases, arabinoxylan hydrolases, galacturonases, lyases, or amylolytic enzymes; hydrolase, isomerase, or ligase, phosphatases such as phytases, esterases such as lipases, proteolytic enzymes, oxidoreductases such as oxidases, transferases, or isomerases. The enzyme may be a phytase. The enzyme may be an aminopeptidase, asparaginase, amylase, a maltogenic amylase, carbohydrase, carboxypeptidase, endo-protease, metallo-protease, serine-protease catalase, chitinase, cutinase, cyclodextrin glycosyltransferase, deoxyribonuclease, esterase, alpha-galactosidase, beta-galactosidase, glucoamylase, alpha-glucosidase, beta-glucosidase, haloperoxidase, protein deaminase, invertase, laccase, lipase, mannosidase, mutanase, oxidase, pectinolytic enzyme, peroxidase, phospholipase, galactolipase, chlorophyllase, polyphenoloxidase, ribonuclease, transglutaminase, or glucose oxidase, hexose oxidase, monooxygenase.

According to the present invention, a compound of interest can be a polypeptide or enzyme with improved secretion features as described in WO2010/102982. According to the present invention, a compound of interest can be a fused or hybrid polypeptide to which another polypeptide is fused at the N-terminus or the C-terminus of the polypeptide or fragment thereof. A fused polypeptide is produced by fusing a nucleic acid sequence (or a portion thereof) encoding one polypeptide to a nucleic acid sequence (or a portion thereof) encoding another polypeptide. Techniques for producing fusion polypeptides are known in the art, and include, ligating the coding sequences encoding the polypeptides so that they are in frame and expression of the fused polypeptide is under control of the same promoter(s) and terminator. The hybrid polypeptides may comprise a combination of partial or complete polypeptide sequences obtained from at least two different polypeptides wherein one or more may be heterologous to the host cell. Example of fusion polypeptides and signal sequence fusions are for example as described in WO2010/121933.

The biopolymer may be a polysaccharide. The polysaccharide may be any polysaccharide, including, but not limited to, a mucopolysaccharide (e. g., heparin and hyaluronic acid) and nitrogen-containing polysaccharide (e.g., chitin). In a preferred option, the polysaccharide is hyaluronic acid.

A polynucleotide coding for the compound of interest or coding for a compound involved in the production of the compound of interest according to the invention may encode an enzyme involved in the synthesis of a primary or secondary metabolite, such as organic acids, carotenoids, (beta-lactam) antibiotics, and vitamins. Such metabolite may be considered as a biological compound according to the present invention.

The term "metabolite" encompasses both primary and secondary metabolites; the metabolite may be any metabolite. Preferred metabolites are citric acid, gluconic acid, adipic acid, fumaric acid, itaconic acid and succinic acid.

A metabolite may be encoded by one or more genes, such as in a biosynthetic or metabolic pathway. Primary metabolites are products of primary or general metabolism of a cell, which are concerned with energy metabolism, growth, and structure. Secondary metabolites are products of secondary metabolism (see, for example, R. B. Herbert, The Biosynthesis of Secondary Metabolites, Chapman and Hall, New York, 1981).

A primary metabolite may be, but is not limited to, an amino acid, fatty acid, nucleoside, nucleotide, sugar, triglyceride, or vitamin.

A secondary metabolite may be, but is not limited to, an alkaloid, coumarin, flavonoid, polyketide, quinine, steroid, peptide, or terpene. The secondary metabolite may be an antibiotic, antifeedant, attractant, bacteriocide, fungicide, hormone, insecticide, or rodenticide. Preferred antibiotics are cephalosporins and beta-lactams. Other preferred metabolites are exo-metabolites. Examples of exo-metabolites are Aurasperone B, Funalenone, Kotanin, Nigragillin, Orlandin, Other naphtho-γ-pyrones, Pyranonigrin A, Tensidol B, Fumonisin B2 and Ochratoxin A.

The biological compound may also be the product of a selectable marker. A selectable marker is a product of a polynucleotide of interest which product provides for biocide or viral resistance, resistance to heavy metals, prototrophy to auxotrophs, and the like. Selectable markers include, but are not limited to, amdS (acetamidase), argB (ornithinecarbamoyltransferase), bar (phosphinothricinacetyltransferase), hygB (hygromycin phosphotransferase), niaD (nitrate reductase), pyrG (orotidine-5'-phosphate decarboxylase), sC (sulfate adenyltransferase), trpC (anthranilate synthase), ble (phleomycin resistance protein), hyg (hygromycin), NAT or NTC (Nourseothricin) as well as equivalents thereof.

According to the invention, a compound of interest is preferably a polypeptide as described in the list of compounds of interest.

According to another embodiment of the invention, a compound of interest is preferably a metabolite.

The host cell according to the present invention may already be capable of producing the compound of interest. The mutant microbial host cell may also be provided with a homologous or heterologous nucleic acid construct that encodes a polypeptide wherein the polypeptide may be the compound of interest or a polypeptide involved in the production of the compound of interest. The person skilled in the art knows how to modify a microbial host cell such that it is capable of producing the compound of interest General Definitions Throughout the present specification and the accompanying claims, the words "comprise", "include" and "having" and variations such as "comprises", "comprising", "includes" and "including" are to be interpreted inclusively. That is, these words are intended to convey the possible inclusion of other elements or integers not specifically recited, where the context allows.

The terms "a" and "an" are used herein to refer to one or to more than one (i.e. to one or at least one) of the grammatical object of the article. By way of example, "an element" may mean one element or more than one element.

The word "about" or "approximately" when used in association with a numerical value (e.g. about 10) preferably means that the value may be the given value (of 10) more or less 1% of the value.

A preferred nucleotide analogue or equivalent comprises a modified backbone. Examples of such backbones are provided by morpholino backbones, carbamate backbones, siloxane backbones, sulfide, sulfoxide and sulfone backbones, formacetyl and thioformacetyl backbones, methyleneformacetyl backbones, riboacetyl backbones, alkene containing backbones, sulfamate, sulfonate and sulfonamide backbones, methyleneimino and methylenehydrazino backbones, and amide backbones. It is further preferred that the linkage between a residue in a backbone does not include a phosphorus atom, such as a linkage that is formed by short chain alkyl or cycloalkyl internucleoside linkages, mixed heteroatom and alkyl or cycloalkyl internucleoside linkages, or one or more short chain heteroatomic or heterocyclic internucleoside linkages.

A preferred nucleotide analogue or equivalent comprises a Peptide Nucleic Acid (PNA), having a modified polyamide backbone (Nielsen, et al. (1991) Science 254, 1497-1500). PNA-based molecules are true mimics of DNA molecules in terms of base-pair recognition. The backbone of the PNA is composed of N-(2-aminoethyl)-glycine units linked by peptide bonds, wherein the nucleobases are linked to the backbone by methylene carbonyl bonds. An alternative backbone comprises a one-carbon extended pyrrolidine PNA monomer (Govindaraju and Kumar (2005) Chem. Commun, 495-497). Since the backbone of a PNA molecule contains no charged phosphate groups, PNA-RNA hybrids are usually more stable than RNA-RNA or RNA-DNA hybrids, respectively (Egholm et al (1993) Nature 365, 566-568).

A further preferred backbone comprises a morpholino nucleotide analog or equivalent, in which the ribose or deoxyribose sugar is replaced by a 6-membered morpholino ring. A most preferred nucleotide analog or equivalent comprises a phosphorodiamidate morpholino oligomer (PMO), in which the ribose or deoxyribose sugar is replaced by a 6-membered morpholino ring, and the anionic phosphodiester linkage between adjacent morpholino rings is replaced by a non-ionic phosphorodiamidate linkage.

A further preferred nucleotide analogue or equivalent comprises a substitution of at least one of the non-bridging oxygens in the phosphodiester linkage. This modification slightly destabilizes base-pairing but adds significant resistance to nuclease degradation. A preferred nucleotide analogue or equivalent comprises phosphorothioate, chiral phosphorothioate, phosphorodithioate, phosphotriester, aminoalkylphosphotriester, H-phosphonate, methyl and other alkyl phosphonate including 3'-alkylene phosphonate, 5'-alkylene phosphonate and chiral phosphonate, phosphinate, phosphoramidate including 3'-amino phosphoramidate and aminoalkylphosphoramidate, thionophosphoramidate, thionoalkylphosphonate, thionoalkylphosphotriester, selenophosphate or boranophosphate. A further preferred nucleotide analogue or equivalent comprises one or more sugar moieties that are mono- or disubstituted at the 2', 3' and/or 5' position such as a —OH; —F; substituted or unsubstituted, linear or branched lower (C1-C10) alkyl, alkenyl, alkynyl, alkaryl, allyl, aryl, or aralkyl, that may be interrupted by one or more heteroatoms; O-, S-, or N-alkyl; O-, S-, or N-alkenyl; O-, S- or N-alkynyl; O-, S-, or N-allyl; O-alkyl-O-alkyl, -methoxy, -aminopropoxy; aminoxy, methoxyethoxy; -dimethylaminooxyethoxy; and -dimethylaminoethoxyethoxy. The sugar moiety can be a pyranose or derivative thereof, or a deoxypyranose or derivative thereof, preferably a ribose or a derivative thereof, or deoxyribose or derivative thereof. Such preferred derivatized sugar moieties comprise Locked Nucleic Acid (LNA), in which the 2'-carbon atom is linked to the 3' or 4' carbon atom of the sugar ring thereby forming a bicyclic sugar moiety. A preferred LNA comprises 2'-O,4'-C-ethylene-bridged nucleic acid (Morita et al. 2001. Nucleic Acid Res Supplement No. 1: 241-242). These substitutions render the nucleotide analogue or equivalent RNase H and nuclease resistant and increase the affinity for the target.

"Sequence identity" or "identity" in the context of the present invention of an amino acid- or nucleic acid-sequence is herein defined as a relationship between two or more amino acid (peptide, polypeptide, or protein) sequences or two or more nucleic acid (nucleotide, oligonucleotide, polynucleotide) sequences, as determined by comparing the sequences. In the art, "identity" also means the degree of sequence relatedness between amino acid or nucleotide sequences, as the case may be, as determined by the match between strings of such sequences. Within the present invention, sequence identity with a particular sequence preferably means sequence identity over the entire length of said particular polypeptide or polynucleotide sequence.

"Similarity" between two amino acid sequences is determined by comparing the amino acid sequence and its conserved amino acid substitutes of one peptide or polypeptide to the sequence of a second peptide or polypeptide. In a preferred embodiment, identity or similarity is calculated over the whole sequence (SEQ ID NO:) as identified herein. "Identity" and "similarity" can be readily calculated by known methods, including but not limited to those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heine, G., Academic Press, 1987; and Sequence Analysis Primer, Gribskov, M. and Devereux, J., eds., M Stockton Press, New York, 1991; and Carillo, H., and Lipman, D., SIAM J. Applied Math., 48:1073 (1988). Preferred methods to determine identity are designed to give the largest match between the sequences tested. Methods to determine identity and similarity are codified in publicly available computer programs. Preferred computer program methods to determine identity and similarity between two sequences include e.g. the GCG program package (Devereux, J., et al., Nucleic Acids Research 12 (1): 387 (1984)), BestFit, BLASTP, BLASTN, and FASTA (Altschul, S. F. et al., J. Mol. Biol. 215:403-410 (1990). The BLAST X program is publicly available from NCBI and other sources (BLAST Manual, Altschul, S., et al., NCBI NLM NIH Bethesda, Md. 20894; Altschul, S., et al., J. Mol. Biol. 215:403-410 (1990). The well-known Smith Waterman algorithm may also be used to determine identity.

Preferred parameters for polypeptide sequence comparison include the following: Algorithm: Needleman and Wunsch, J. Mol. Biol. 48:443-453 (1970); Comparison matrix: BLOSSUM62 from Hentikoff and Hentikoff, Proc. Natl. Acad. Sci. USA. 89:10915-10919 (1992); Gap Penalty: 12; and Gap Length Penalty: 4. A program useful with these parameters is publicly available as the "Ogap" program from Genetics Computer Group, located in Madison, Wis. The aforementioned parameters are the default parameters for amino acid comparisons (along with no penalty for end gaps).

Preferred parameters for nucleic acid comparison include the following: Algorithm: Needleman and Wunsch, J. Mol. Biol. 48:443-453 (1970); Comparison matrix: matches=+10, mismatch=0; Gap Penalty: 50; Gap Length Penalty: 3. Available as the Gap program from Genetics Computer Group, located in Madison, Wis. Given above are the default parameters for nucleic acid comparisons.

Optionally, in determining the degree of amino acid similarity, the skilled person may also take into account so-called "conservative" amino acid substitutions, as will be clear to the skilled person. Conservative amino acid substitutions refer to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulphur-containing side chains is cysteine and methionine. Preferred conservative amino acids substitution groups are: valine-leucine-isoleucine, phenylalanine-tyrosine, lysine-arginine, alanine-valine, and asparagine-glutamine. Substitutional variants of the amino acid sequence disclosed herein are those in which at least one residue in the disclosed sequences has been removed and a different residue inserted in its place. Preferably, the amino acid change is conservative. Preferred conservative substitutions for each of the naturally occurring amino acids are as follows: Ala to ser; Arg to lys; Asn to gln or his; Asp to glu; Cys to ser or ala; Gln to asn; Glu to asp; Gly to pro; His to asn or gln; Ile to leu or val; Leu to ile or val; Lys to arg; gln or glu; Met to leu or ile; Phe to met, leu or tyr; Ser to thr; Thr to ser; Trp to tyr; Tyr to trp or phe; and, Val to ile or leu.

A polynucleotide according to the present invention is represented by a nucleotide sequence. A polypeptide according to the present invention is represented by an amino acid sequence. A nucleic acid construct according to the present invention is defined as a polynucleotide which is isolated from a naturally occurring gene or which has been modified to contain segments of polynucleotides which are combined or juxtaposed in a manner which would not otherwise exist in nature. Optionally, a polynucleotide present in a nucleic acid construct according to the present invention is operably linked to one or more control sequences, which direct the production or expression of the encoded product in a host cell or in a cell-free system.

The sequence information as provided herein should not be so narrowly construed as to require inclusion of erroneously identified bases. The skilled person is capable of identifying such erroneously identified bases and knows how to correct for such errors.

All embodiments of the present invention, i.e. a composition according to the present invention, a method of modulating expression, a host cell comprising a composition according to the present invention, a method of producing a host cell according to the present invention, a host cell according to the present invention and a method for the production of a compound of interest according to the present invention preferably refer to host cell, not to a cell-free in vitro system; in other words, the CRISPR-Cas systems according to the present invention are preferably host cell systems, not cell-free in vitro systems.

In all embodiments of the present invention, e.g. a composition according to the present invention, a method of modulating expression, a host cell comprising a composition according to the present invention, a method of producing a host cell according to the present invention, a host cell according to the present invention and a method for the production of a compound of interest according to the present invention, the host cell may be a haploid, diploid or polyploid host cell.

The host cell according to the present invention a yeast host cell, a preferred yeast host cell is from a genus selected from the group consisting of *Candida, Hansenula, Issatchenkia, Kluyveromyces, Pichia, Saccharomyces, Schizosaccharomyces, Yarrowia* or *Zygosaccharomyces*; more preferably a yeast host cell is selected from the group consisting of *Kluyveromyces lactis, Kluyveromyces lactis* NRRL Y-1140, *Kluyveromyces marxianus, Kluyveromyces. thermotolerans, Candida krusei, Candida sonorensis, Candida glabrata, Saccharomyces cerevisiae, Saccharomyces cerevisiae* CEN.PK113-7D, *Schizosaccharomyces pombe, Hansenula polymorpha, Issatchenkia orientalis, Yarrowia lipolytica, Yarrowia lipolytica* CLIB122, *Pichia stipidis* and *Pichia pastoris*.

Preferably, a host cell according to the present invention further comprises one or more modifications in its genome such that the host cell is deficient in the production of at least one product selected from glucoamylase (glaA), acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, PepA, a product encoded by the gene hdfA and/or hdfB, a non-ribosomal peptide synthase npsE if compared to a parent host cell and measured under the same conditions.

Preferably, the efficiency of targeted integration of a polynucleotide to a pre-determined site into the genome of a host cell according to the invention is increased by rendering the cell deficient in a component in NHEJ (non-homologous recombination). Preferably, a host cell according to the invention comprises a polynucleotide encoding an NHEJ component comprising a modification, wherein said host cell is deficient in the production of said NHEJ component compared to a parent cell it originates from when cultivated under the same conditions.

The NHEJ component to be modified can be any NHEJ component known to the person skilled in the art. Preferred NHEJ components to be modified are selected from the group of yeast KU70, KU80, MRE11, RAD50, RAD51, RAD52, XRS2, SIR4, LIG4. Methods to obtain such host cell deficient in a component involved in NHEJ are known to the skilled person and are extensively described in WO2005/095624

The deficiency in the production of at least one product selected from glucoamylase (glaA), acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, PepA, a product encoded by the gene hdfA and/or hdfB, a non-ribosomal peptide synthase npsE, amylase amyC if compared to a parent host cell and measured under the same conditions may already be present in a parent host cell from which a host cell according to the present invention that is deficient in a further product selected from the group consisting of glucoamylase (glaA), acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, PepA, a product encoded by the gene hdfA and/or hdfB, a non-ribosomal peptide synthase npsE, amylase amyC is derived.

A modification, preferably in the genome, is construed herein as one or more modifications. A modification, preferably in the genome of a host cell according to the present invention, can either be effected by a) subjecting a parent host cell to recombinant genetic manipulation techniques; and/or
b) subjecting a parent host cell to (classical) mutagenesis; and/or
c) subjecting a parent host cell to an inhibiting compound or composition. Modification of a genome of a host cell is herein defined as any event resulting in a change in a polynucleotide sequence in the genome of the host cell.

Preferably, a host cell according to the present invention has a modification, preferably in its genome which results in a reduced or no production of an undesired compound as defined herein if compared to the parent host cell that has not been modified, when analysed under the same conditions.

A modification can be introduced by any means known to the person skilled in the art, such as but not limited to classical strain improvement, random mutagenesis followed by selection. Modification can also be introduced by site-directed mutagenesis.

Modification may be accomplished by the introduction (insertion), substitution (replacement) or removal (deletion) of one or more nucleotides in a polynucleotide sequence. A full or partial deletion of a polynucleotide coding for an undesired compound such as a polypeptide may be achieved. An undesired compound may be any undesired compound listed elsewhere herein; it may also be a protein and/or enzyme in a biological pathway of the synthesis of an undesired compound such as a metabolite. Alternatively, a polynucleotide coding for said undesired compound may be partially or fully replaced with a polynucleotide sequence which does not code for said undesired compound or that codes for a partially or fully inactive form of said undesired compound. In another alternative, one or more nucleotides can be inserted into the polynucleotide encoding said undesired compound resulting in the disruption of said polynucleotide and consequent partial or full inactivation of said undesired compound encoded by the disrupted polynucleotide.

In one embodiment the mutant microbial host cell according to the invention comprises a modification in its genome selected from a) a full or partial deletion of a polynucleotide encoding an undesired compound,
b) a full or partial replacement of a polynucleotide encoding an undesired compound with a polynucleotide sequence which does not code for said undesired compound or that codes for a partially or fully inactive form of said undesired compound.
c) a disruption of a polynucleotide encoding an undesired compound by the insertion of one or more nucleotides in the polynucleotide sequence and consequent partial or full inactivation of said undesired compound by the disrupted polynucleotide.

This modification may for example be in a coding sequence or a regulatory element required for the transcription or translation of said undesired compound. For example, nucleotides may be inserted or removed so as to result in the introduction of a stop codon, the removal of a start codon or a change or a frame-shift of the open reading frame of a coding sequence. The modification of a coding sequence or a regulatory element thereof may be accomplished by site-directed or random mutagenesis, DNA shuffling methods, DNA reassembly methods, gene synthesis (see for example Young and Dong, (2004), *Nucleic Acids Research* 32, (7) or Gupta et al. (1968), *Proc. Natl. Acad. Sci USA,* 60: 1338-1344; Scarpulla et al. (1982), *Anal. Biochem.* 121: 356-365; Stemmer et al. (1995), *Gene* 164: 49-53), or PCR generated mutagenesis in accordance with methods known in the art. Examples of random mutagenesis procedures are well known in the art, such as for example chemical (NTG for example) mutagenesis or physical (UV for example) mutagenesis. Examples of site-directed mutagenesis procedures are the QuickChange™ site-directed mutagenesis kit (Stratagene Cloning Systems, La Jolla, Calif.), the The Altered Sites® II in vitro Mutagenesis Systems' (Promega Corporation) or by overlap extension using PCR as described in Gene. 1989 Apr. 15; 77(1):51-9. (Ho S N, Hunt H D, Horton R M, Pullen J K, Pease L R "Site-directed mutagenesis by overlap extension using the polymerase chain reaction") or using PCR as described in *Molecular Biology: Current Innovations and Future Trends*. (Eds. A. M. Griffin and H. G. Griffin. ISBN 1-898486-01-8; 1995 Horizon Scientific Press, PO Box 1, Wymondham, Norfolk, U.K.).

Preferred methods of modification are based on recombinant genetic manipulation techniques such as partial or complete gene replacement or partial or complete gene deletion.

For example, in case of replacement of a polynucleotide, nucleic acid construct or expression cassette, an appropriate DNA sequence may be introduced at the target locus to be replaced. The appropriate DNA sequence is preferably present on a cloning vector. Preferred integrative cloning vectors comprise a DNA fragment, which is homologous to the polynucleotide and/or has homology to the polynucleotides flanking the locus to be replaced for targeting the integration of the cloning vector to this pre-determined locus. In order to promote targeted integration, the cloning vector is preferably linearized prior to transformation of the cell. Preferably, linearization is performed such that at least one but preferably either end of the cloning vector is flanked by sequences homologous to the DNA sequence (or flanking sequences) to be replaced. This process is called homologous recombination and this technique may also be used in order to achieve (partial) gene deletion.

For example a polynucleotide corresponding to the endogenous polynucleotide may be replaced by a defective polynucleotide, that is a polynucleotide that fails to produce a (fully functional) polypeptide. By homologous recombination, the defective polynucleotide replaces the endogenous polynucleotide. It may be desirable that the defective polynucleotide also encodes a marker, which may be used for selection of transformants in which the nucleic acid sequence has been modified.

Alternatively or in combination with other mentioned techniques, a technique based on in vivo recombination of cosmids in *E. coli* can be used, as described in: *A rapid method for efficient gene replacement in the filamentous fungus Aspergillus nidulans* (2000) Chaveroche, M-K., Ghico, J-M. and d'Enfert C; *Nucleic acids Research*, vol 28, no 22. Alternatively, modification, wherein said host cell produces less of or no protein such as the polypeptide having amylase activity, preferably α-amylase activity as described herein and encoded by a polynucleotide as described herein, may be performed by established anti-sense techniques using a nucleotide sequence complementary to the nucleic acid sequence of the polynucleotide. More specifically, expression of the polynucleotide by a host cell may be reduced or eliminated by introducing a nucleotide sequence complementary to the nucleic acid sequence of the polynucleotide, which may be transcribed in the cell and is capable of hybridizing to the mRNA produced in the cell. Under conditions allowing the complementary anti-sense nucleotide sequence to hybridize to the mRNA, the amount of protein translated is thus reduced or eliminated. An example of expressing an antisense-RNA is shown in Appl. Environ. Microbiol. 2000 February; 66(2):775-82. (*Characterization of a foldase, protein disulfide isomerase A, in the protein secretory pathway of Aspergillus niger*. Ngiam C, Jeenes D J, Punt P J, Van Den Hondel C A, Archer D B) or (Zrenner R, Willmitzer L, Sonnewald U. *Analysis of the expression of potato uridinediphosphate-glucose pyrophosphorylase and its inhibition by antisense RNA. Planta.* (1993); 190(2):247-52.).

A modification resulting in reduced or no production of undesired compound is preferably due to a reduced production of the mRNA encoding said undesired compound if compared with a parent microbial host cell which has not been modified and when measured under the same conditions.

A modification which results in a reduced amount of the mRNA transcribed from the polynucleotide encoding the undesired compound may be obtained via the RNA interference (RNAi) technique (Mouyna et al., 2004). In this method identical sense and antisense parts of the nucleotide sequence, which expression is to be affected, are cloned behind each other with a nucleotide spacer in between, and inserted into an expression vector. After such a molecule is transcribed, formation of small nucleotide fragments will lead to a targeted degradation of the mRNA, which is to be affected. The elimination of the specific mRNA can be to various extents. The RNA interference techniques described in WO2008/053019, WO2005/05672A1, WO2005/026356A1, Oliveira et al.,; Crook et al., 2014; and/or Barnes et al., may be used at this purpose.

A modification which results in decreased or no production of an undesired compound can be obtained by different methods, for example by an antibody directed against such undesired compound or a chemical inhibitor or a protein inhibitor or a physical inhibitor (Tour O. et al, (2003) Nat. Biotech: Genetically targeted chromophore-assisted light inactivation. Vol. 21. no. 12:1505-1508) or peptide inhibitor or an anti-sense molecule or RNAi molecule (R. S. Kamath_et al, (2003) Nature: Systematic functional analysis of the *Caenorhabditis elegans* genome using RNAi.vol. 421, 231-237).

In addition of the above-mentioned techniques or as an alternative, it is also possible to inhibiting the activity of an undesired compound, or to re-localize the undesired compound such as a protein by means of alternative signal sequences (Ramon de Lucas, J., Martinez O, Perez P., Isabel Lopez, M., Valenciano, S. and Laborda, F. The *Aspergillus nidulans* carnitine carrier encoded by the acuH gene is exclusively located in the mitochondria. FEMS Microbiol Lett. 2001 Jul. 24; 201(2):193-8.) or retention signals (Derkx, P. M. and Madrid, S. M. The foldase CYPB is a component of the secretory pathway of *Aspergillus niger* and contains the endoplasmic reticulum retention signal HEEL. Mol. Genet. Genomics. 2001 December; 266(4): 537-545), or by targeting an undesired compound such as a polypeptide to a peroxisome which is capable of fusing with a membrane-structure of the cell involved in the secretory pathway of the cell, leading to secretion outside the cell of the polypeptide (e.g. as described in WO2006/040340).

Alternatively or in combination with above-mentioned techniques, decreased or no production of an undesired compound can also be obtained, e.g. by UV or chemical mutagenesis (Mattern, I. E., van Noort J. M., van den Berg, P., Archer, D. B., Roberts, I. N. and van den Hondel, C. A., Isolation and characterization of mutants of *Aspergillus niger* deficient in extracellular proteases. Mol Gen Genet. 1992 August; 234(2):332-6.) or by the use of inhibitors inhibiting enzymatic activity of an undesired polypeptide as described herein (e.g. nojirimycin, which function as inhibitor for β-glucosidases (Carrel F. L. Y. and Canevascini G. *Canadian Journal of Microbiology* (1991) 37(6): 459-464; Reese E. T., Parrish F. W. and Ettlinger M. *Carbohydrate Research* (1971) 381-388)).

In an embodiment of the present invention, the modification in the genome of the host cell according to the invention is a modification in at least one position of a polynucleotide encoding an undesired compound.

A deficiency of a cell in the production of a compound, for example of an undesired compound such as an undesired polypeptide and/or enzyme is herein defined as a mutant microbial host cell which has been modified, preferably in its genome, to result in a phenotypic feature wherein the cell: a) produces less of the undesired compound or produces substantially none of the undesired compound and/or b) produces the undesired compound having a decreased activity or decreased specific activity or the undesired compound having no activity or no specific activity and combinations of one or more of these possibilities as compared to the parent host cell that has not been modified, when analysed under the same conditions.

Preferably, a modified host cell according to the present invention produces 1% less of the un-desired compound if compared with the parent host cell which has not been modified and measured under the same conditions, at least 5% less of the un-desired compound, at least 10% less of the un-desired compound, at least 20% less of the un-desired compound, at least 30% less of the un-desired compound, at least 40% less of the un-desired compound, at least 50% less of the un-desired compound, at least 60% less of the un-desired compound, at least 70% less of the un-desired compound, at least 80% less of the un-desired compound, at least 90% less of the un-desired compound, at least 91% less of the un-desired compound, at least 92% less of the un-desired compound, at least 93% less of the un-desired compound, at least 94% less of the un-desired compound, at least 95% less of the un-desired compound, at least 96% less of the un-desired compound, at least 97% less of the un-desired compound, at least 98% less of the un-desired compound, at least 99% less of the un-desired compound, at least 99.9% less of the un-desired compound, or most preferably 100% less of the un-desired compound.

A reference herein to a patent document or other matter which is given as prior art is not to be taken as an admission that that document or matter was known or that the information it contains was part of the common general knowledge as at the priority date of any of the claims.

The sequence information as provided herein should not be so narrowly construed as to require inclusion of erroneously identified bases. The skilled person is capable of identifying such erroneously identified bases and knows how to correct for such errors. The disclosure of each reference set forth herein is incorporated herein by reference in its entirety.

The present invention is further illustrated by the following examples:

EXAMPLES

To enable genome precision engineering in the yeast *Saccharomyces cerevisiae* using the RNA-guided CRISPR/CAS9 system, the essential components being the CAS9 protein and the crRNA-tracrRNA fusion transcript (referred as guide-RNA or gRNA), should be expressed at the same time within the yeast cell. It was shown that the CAS9 protein can be expressed from a single copy vector using a centromeric episomal vector (pRS414, TRP1 selection marker or pRS415, Leu2 selection marker; Sikorski and Hieter, 1989) together with a 2 mu vector (pRS426, URA3 selection marker Christianson et al., 1992) expressing the guide-RNA and introducing donor DNA in the transformation, resulting in cells with near 100% donor DNA recombination frequency as shown by introduction of a desired mutation (DiCarlo et al., 2013). The drawback of this approach is that CAS9 and the guide-RNA have to be expressed from two different expression vectors and that the yeast cells to which the pRS414/pRS415 and pRS426 vectors have to be transformed need to be auxotrophic for tryptophan or leucine in combination with an auxotrophy for uracil. Auxotrophies may be common for laboratory yeasts, but not for wildtype of industrial yeast, which make this two vector system with autotrophic markers inappropriate to work with for the mentioned yeasts. In a recent study, pRS414 containing a human codon optimized CAS9 expression cassette as described within the DiCarlo et al., 2013 paper was equipped with a NAT1 selection marker, allowing selection on nourseothricin (Zhang et al., 2014), thus selection on an auxotrophic marker is no longer required. The guide-RNA was expressed from a 2 mu vector containing a hygromycin marker (Zhang et al., 2014). The disadvantage of this approach is that two vectors need to be transformed and selection on two antibiotics is required for a functional CRISPR/CAS9 system.

Example 1: Construction of "all-in-One" Yeast Expression Vectors

In order to construct a yeast expression vector containing CAS9, guide-RNA and an antibiotic resistance marker, the following approach was taken. First, two SapI restriction sites present in vector pRS426 (Christianson et al., 1992) were mutated in order to remove the two SapI restriction sites, resulting in the vector sequence as set out in SEQ ID NO: 22. The resulting vector was named pRS426-SapI.

The CAS9 nucleotide sequence, which is codon optimized for expression in human cells, was taken from the supplemental data of DiCarlo et al. This sequence encodes a CAS9 protein from *Streptococcus pyogenes* with an additional C-terminal fusion with a SV40 nuclear localization signal (FIG. 15 and Mali et al., 2013). Expression of the human codon optimized CAS9 gene is controlled by the TEF1 promoter and the CYC1 terminator and these are sequences derived from *Saccharomyces cerevisiae* (FIG. 15). The synthetic promoter-gene-terminator sequence including KpnI and NotI restriction sites and sequences homologous to vector pRS414 was synthesized by DNA2.0 (Menlo Park, Calif., USA) and is set out in SEQ ID NO: 9. The sequences homologous to vector pRS414 were included to allow in vivo recombination in yeast of SEQ ID NO: 9 as backup option for KpnI/NotI cloning. Alternatively, the CAS9 protein sequence from *Streptococcus pyogenes* including the additional C-terminal fusion with a SV40 nuclear localization signal was codon pair optimized for expression in *S. cerevisiae* as described in WO2008/000632. Expression of the codon pair optimized CAS9 gene is controlled by the TEF1 promoter and the GND2 terminator and these are sequences derived from *Saccharomyces cerevisiae*. The synthetic promoter-gene-terminator sequence including KpnI and NotI restriction sites was synthesized by DNA2.0 (Menlo Park, Calif., USA) and is set out in SEQ ID NO: 10. Alternatively, the CAS9 protein sequence from *Streptococcus pyogenes* including the additional C-terminal fusion with a SV40 nuclear localization signal was codon pair optimized for expression in *S. cerevisiae* as described in WO2008/000632. Expression of the codon pair optimized CAS9 gene is controlled by the KI11 promoter and the GND2 terminator. The KI11 promoter sequence is derived from *Kluyveromyces lactis* and the GND2 terminator sequence is derived from *Saccharomyces cerevisiae*. The synthetic promoter (including removal of the KpnI restriction site present in the native KI11 promoter sequence)-gene-terminator sequence including KpnI and NotI restriction sites was synthesized by DNA2.0 (Menlo Park, Calif., USA) and is set out in SEQ ID NO: 11. Alternatively, the CAS9 protein sequence from *Streptococcus pyogenes* including the additional C-terminal fusion with a SV40 nuclear localization signal was codon pair optimized for expression in *S. cerevisiae* as described in WO2008/000632. Expression of the codon pair optimized CAS9 gene is controlled by the TDH3 promoter and the GND2 terminator and these are sequences derived from *Saccharomyces cerevisiae*. The synthetic promoter-gene-terminator sequence including KpnI and NotI restriction sites was synthesized by DNA2.0 (Menlo Park, Calif., USA) and is set out in SEQ ID NO: 12. SEQ ID NO: 9 to 12 were delivered in DNA2.0 cloning vectors.

SEQ ID NO: 9, 10, 11 and 12 were digested from the DNA2.0 cloning vectors using KpnI and NotI and KpnI/NotI ligated into vector pRS426-SapI. The ligation mix was used for transformation of *E. coli* NEB 10-beta competent cells (High Efficiency, New England Biolabs, distributed by Doke, the Netherlands) resulting in three intermediate vectors. Unfortunately, construction of the vector containing the *S. cerevisiae* codon pair optimized CAS9 variant expressed using a TEF1 promoter (SEQ ID NO: 10) failed. Subsequently, a functional expression cassette conferring G418 resistance (see euroscarf.de and Güldener et al., 1996) of which the nucleotide sequence is set out in SEQ ID NO: 13, was NotI digested from vector pUG7-KanMX and ligated into the 4 intermediate vectors containing the different CAS9 expression cassettes (SEQ ID NO: 9, 10, 11, 12). Alternatively, a functional expression cassette conferring nourseothricin resistance (see Goldstein and McCusker 1999 and euroscarf.de) was NotI digested from pUG7-NatMX and ligated into the four intermediate vectors containing the different CAS9 expression cassettes. The ligation mix was used for transformation of *E. coli* NEB 10-beta competent cells (High Efficiency, New England Biolabs, distributed by Doke, the Netherlands). This resulted in construction of six different vectors that are depicted in Table 1.

TABLE 1 constructed vectors containing different CAS9 expression cassettes and a dominant marker.

| Vector | Promoter | CAS9 variant | Marker |
| --- | --- | --- | --- |
| pCSN047 | TEF1 | Human codon optimized | KanMX |
| pCSN048 | TEF1 | Human codon optimized | NatMX |
| pCSN049 | KI11 | *S. cerevisiae* codon pair optimized | KanMX |
| pCSN050 | KI11 | *S. cerevisiae* codon pair optimized | NatMX |
| pCSN051 | TDH3 | *S. cerevisiae* codon pair optimized | KanMX |
| pCSN052 | TDH3 | *S. cerevisiae* codon pair optimized | NatMX |

Subsequently, a guide-RNA sequence that directs the CAS9 protein to the ADE2.Y locus (DiCarlo et al., 2013) was cloned into the six expression vectors pCSN047 to pCSN052 (Table 1) using SacII. For this purpose, a synthetic cassette as set out in SEQ ID NO:15 consisting of the SNR52p RNA polymerase III promoter, the ADE2.Y guide-sequence (ACTTGAAGATTCTTTAGTGT; SEQ ID NO: 67), the gRNA structural component and the SUP4 3' flanking region, two SacII restriction sites and sequences homologous to vector pRS426 was synthesized by DNA2.0 (Menlo Park, Calif., USA). The sequences homologous to vector pRS426 were included to allow in vivo recombination in yeast of SEQ ID NO: 9 as backup option for SacII cloning. This resulted in construction of six "all-in-one" expression vectors consisting of a CAS9 variant, a dominant marker and a guide-RNA cassette (Table 2).

TABLE 2 constructed all-in-one vectors containing different CAS9 expression cassettes, ADE2.Y guide-RNA and a dominant marker. All expression cassettes are located in the same orientation (head to tail) on the expression vectors.

Figure 1:
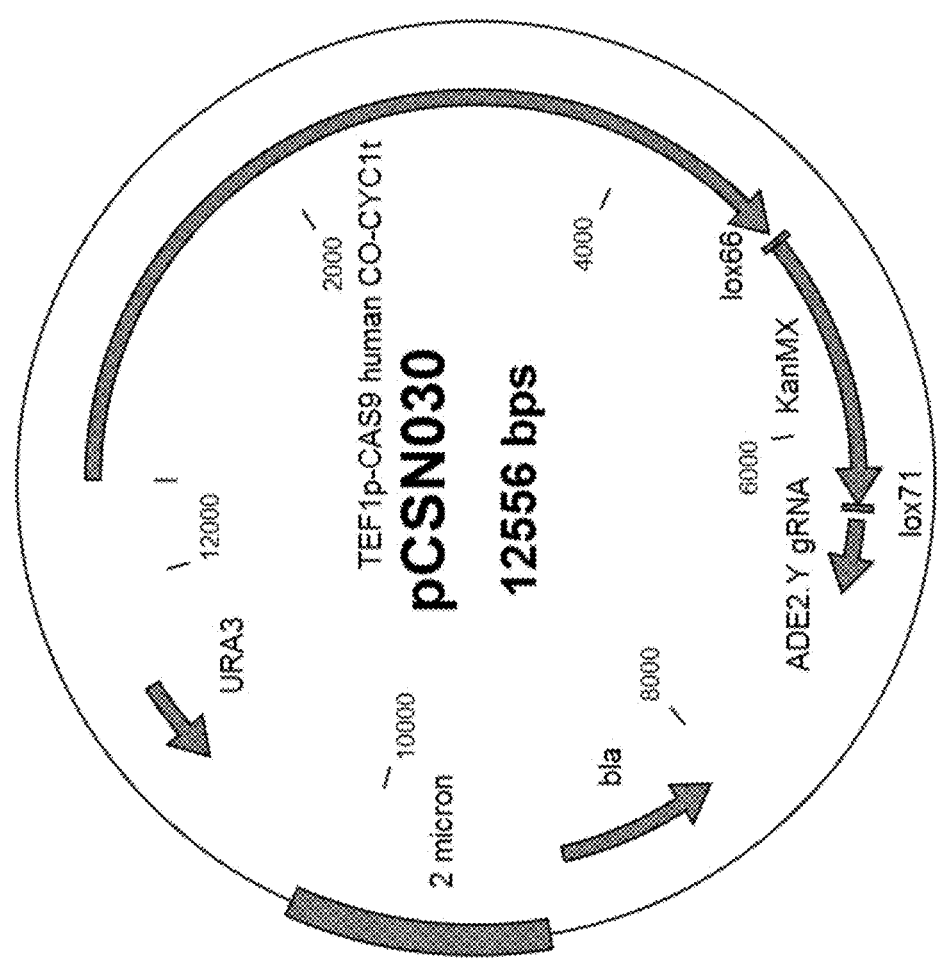
FIG. 1 depicts a vector map of pCSN030 expressing CAS9 human CO (SEQ ID NO: 9) and ADE2.Y guide-RNA, a KanMX marker is present on the all-in-one vector.
Figure 2:
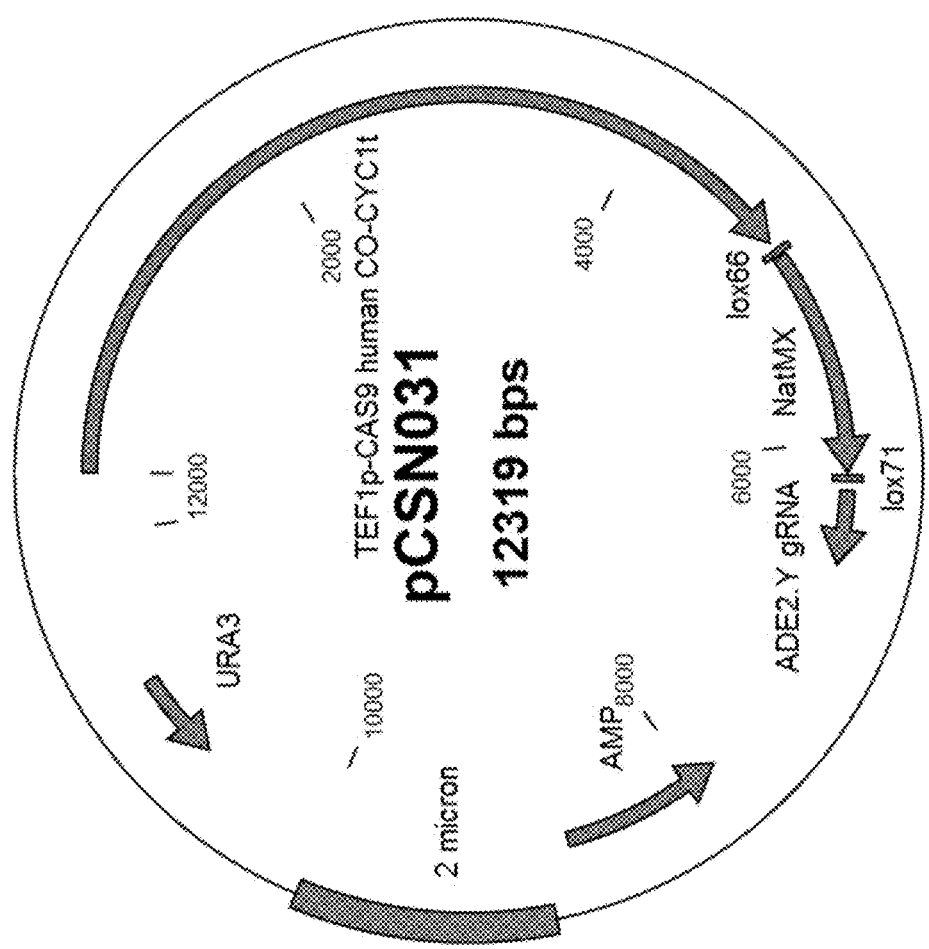
FIG. 2 depicts a vector map of pCSN031 expressing CAS9 human CO (SEQ ID NO: 9) and ADE2.Y guide-RNA, a NatMX marker is present on the all-in-one vector.
Figure 3:
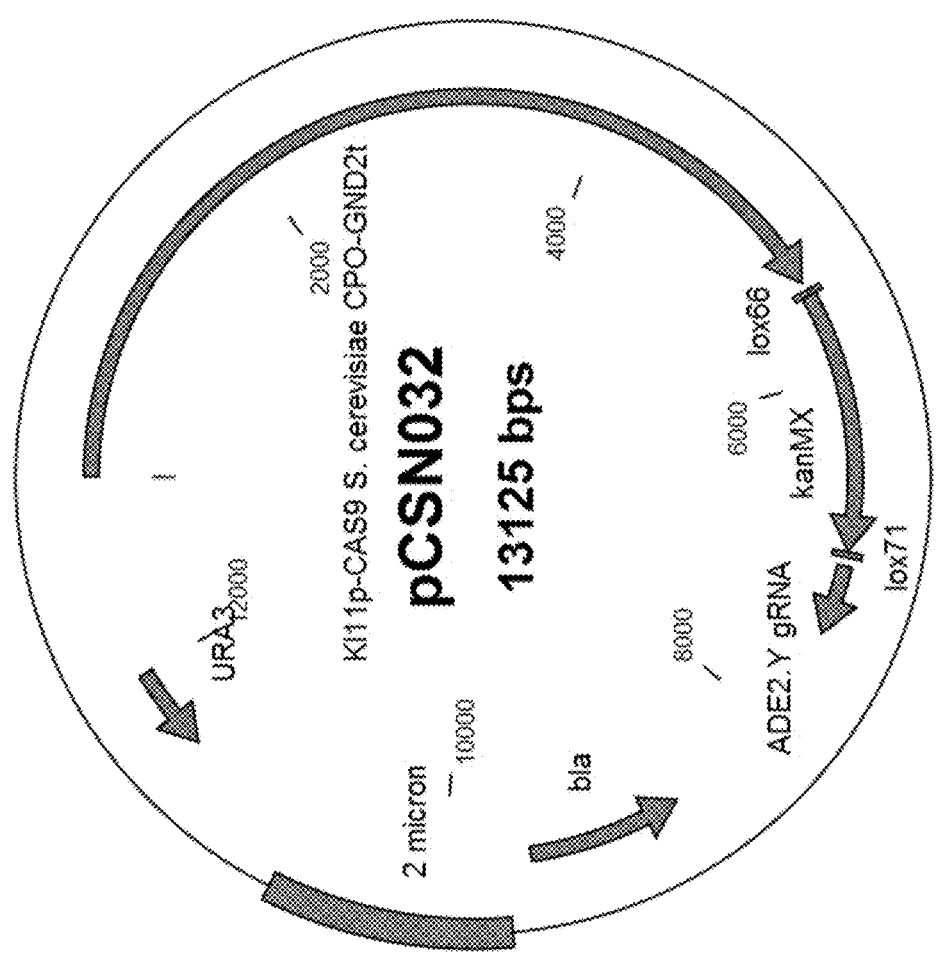
FIG. 3 depicts a vector map of pCSN032 expressing CAS9 codon pair optimized for expression in S. cerevisiae (SEQ ID NO: 11) and ADE2.Y guide-RNA, a KanMX marker is present on the all-in-one vector.
Figure 4:
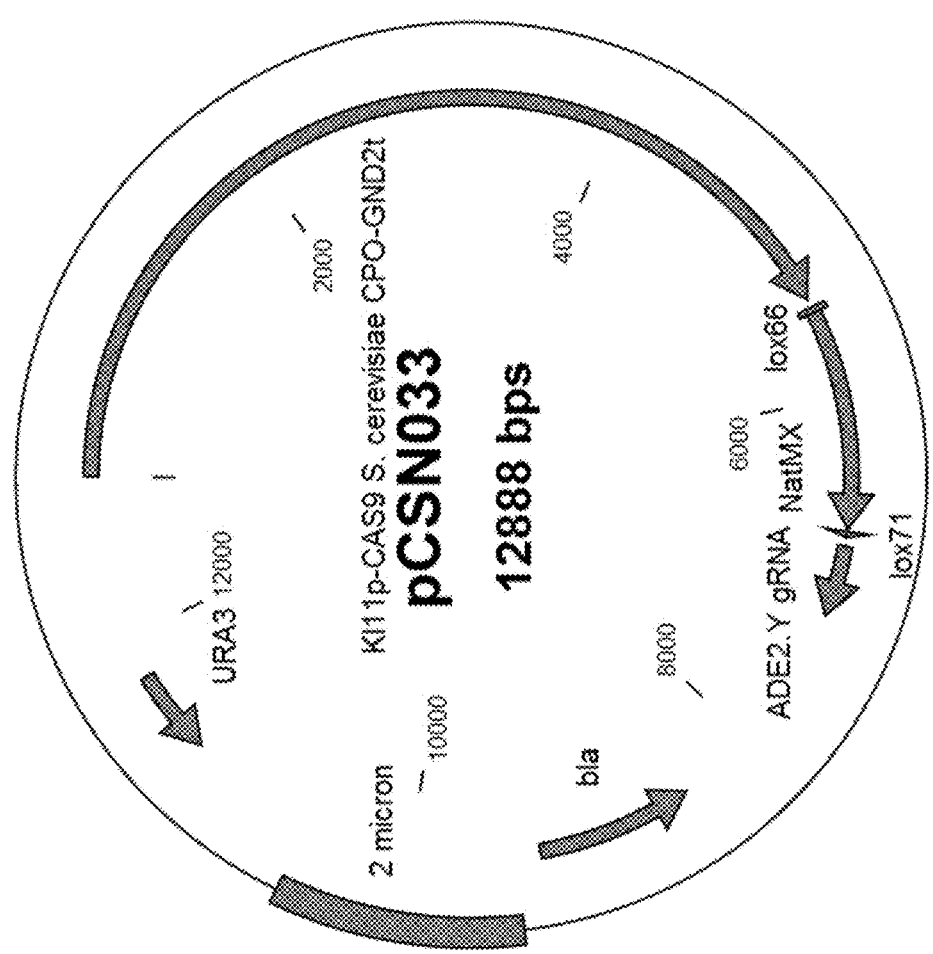
FIG. 4 depicts a vector map of pCSN033 expressing CAS9 codon pair optimized for expression in S. cerevisiae (SEQ ID NO: 11) and ADE2.Y guide-RNA, a NatMX marker is present on the all-in-one vector.
Figure 5:
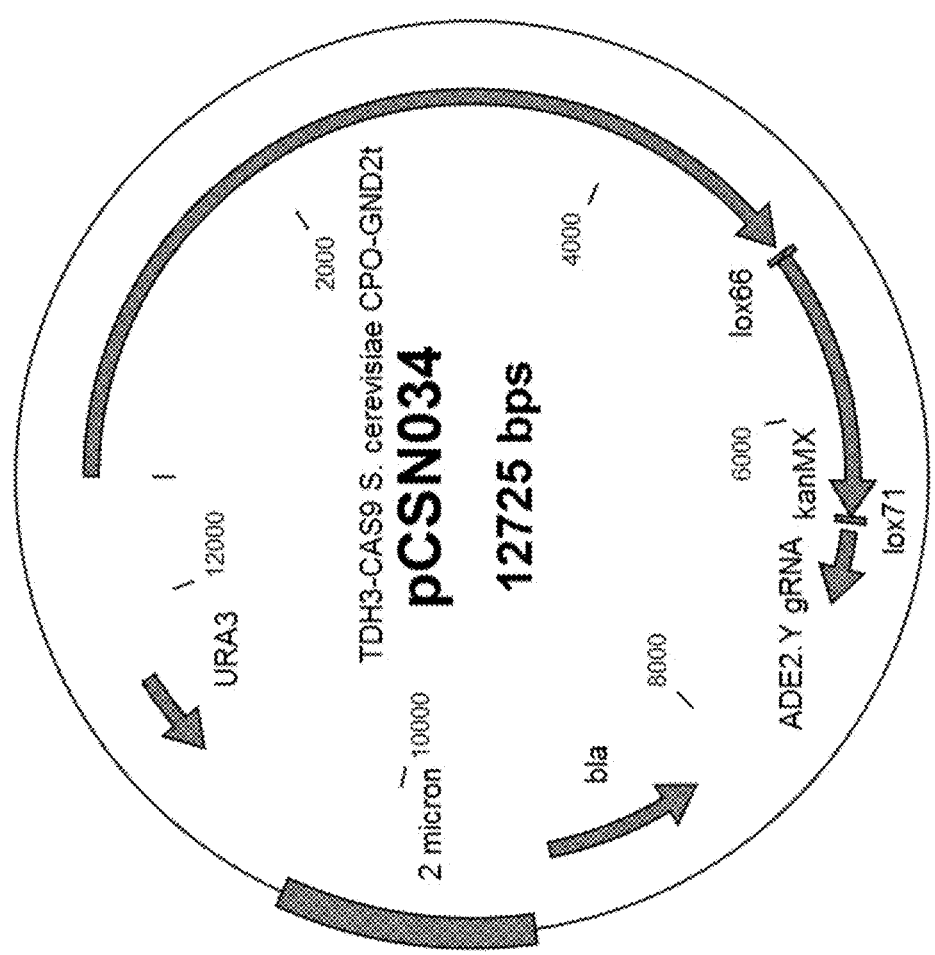
FIG. 5 depicts a vector map of pCSN034 expressing CAS9 codon pair optimized for expression in S. cerevisiae (SEQ ID NO: 12) and ADE2.Y guide-RNA, a KanMX marker is present on the all-in-one vector.
Figure 6:
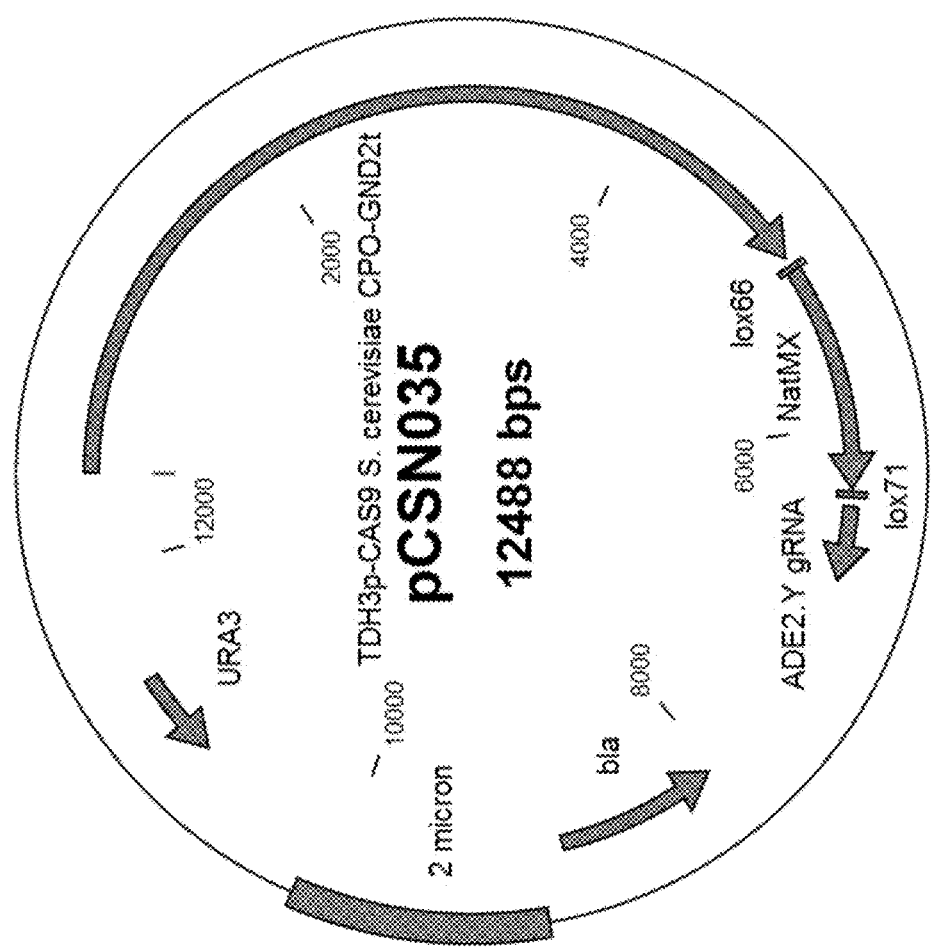
FIG. 6 depicts a vector map of pCSN035 expressing CAS9 codon pair optimized for expression in S. cerevisiae (SEQ ID NO: 12) and ADE2.Y guide-RNA, a NatMX marker is present on the all-in-one vector.

| Vector | Promoter | CAS9 variant | Marker | gRNA | FIG. |
| --- | --- | --- | --- | --- | --- |
| pCSN030 | TEF1 | Human codon optimized | KanMX | ADE2.Y | FIG. 1 |
| pCSN031 | TEF1 | Human codon optimized | NatMX | ADE2.Y | FIG. 2 |
| pCSN032 | KI11 | *S. cerevisiae* codon pair optimized | KanMX | ADE2.Y | FIG. 3 |
| pCSN033 | KI11 | *S. cerevisiae* codon pair optimized | NatMX | ADE2.Y | FIG. 4 |
| pCSN034 | TDH3 | *S. cerevisiae* codon pair optimized | KanMX | ADE2.Y | FIG. 5 |
| pCSN035 | TDH3 | *S. cerevisiae* codon pair optimized | NatMX | ADE2.Y | FIG. 6 |

Example 2: Use of "all-in-One" Yeast Expression Vectors to Mutate the ADE2 Gene in *S. cerevisiae*

To show functionality of the all-in-one vectors, it was aimed to introduce a point mutation into the ADE2 gene in *Saccharomyces cerevisiae* (SEQ ID NO: 23) by introducing a G to T mutation at nucleotide 190, changing codon 64 from a Glu into a Stop-codon (ade2-101 mutation, resulting in red colored yeast colonies, see wiki.yeastgeome.org). For this purpose, a double stranded (DS) oligonucleotide was designed to introduce the G to T mutation at nucleotide position 190, and an additional C to A mutation at position 236 (FIG. 7). The C to A mutation at position 236 was included on the DS oligo to avoid the CAS9 protein from cleaving the DS oligonucleotide donor sequence. Two single stranded (SS) oligonucleotide sequences were synthesized: SEQ ID NO: 16 and SEQ ID NO: 17. A double-stranded oligonucleotide was generated as follows: 20 µl of 100 µM of single stranded oligonucleotide 1 (SEQ ID NO: 16) and 20 µl of 100 µM of single stranded oligonucleotide 1 (SEQ ID NO: 17) were mixed with 10 µl 5× T4 ligase buffer (New England Biolabs, Whitby, Canada). The mixture was kept at 100 degrees Celsius for 5 minutes to denature the oligonucleotides. Subsequently, the temperature was decreased to 25 degrees by a gradual decrease of 1 degree Celsius for 30 seconds in 75 cycles (which is an approximate decrease of 0.0333 degrees per second), allowing the SS oligonucleotides to anneal with each other. The mixture was kept at 10 degrees Celsius if required. The DS oligonucleotide was cleaned and concentrated using the DNA Clean & Concentrator™-5 kit (distributed by Baseclear Lab Products, Leiden, the Netherlands), according to manufacturer's instructions.

*Saccharomyces cerevisiae* strain CEN.PK113-7D (MATa URA3 HIS3 LEU2 TRP1 MAL2-8 SUC2) was transformed using the LiAc/SS carrier DNA/PEG method (Gietz and Woods, 2002). In the transformation mixture 250 nanogram of either vector pCNS030 or pSUC032 or pSUC034 was transformed together with 250 nanogram of the double stranded oligonucleotide donor (see FIG. 7). Transformation mixtures were plated on YPD-agar (10 grams per litre of yeast extract, 20 grams per litre of peptone, 20 grams per litre of dextrose, 20 grams per litre of agar) containing 200 µg G418 (Sigma Aldrich) per ml. After two to four days of growth at 30° C., red colored colonies appeared on the plates. In another transformation mixture, 250 nanograms of either vector pCNS031 or pSUC033 or pSUC035 was transformed together with 250 nanograms of the double stranded (DS) oligonucleotide donor (see FIG. 7). Transformation mixtures were plated on YPD-agar (10 grams per litre of yeast extract, 20 grams per litre of peptone, 20 grams per litre of dextrose, 20 grams per litre of agar) containing 200 µg nourseothricin (NatMX, Jena Bioscience, Germany) per ml. After two to four days of growth at 30° C., red colored colonies appeared on the plates.

Next, a PCR and subsequently sequencing was performed to identify the introduced mutations in the transformants. Genomic gDNA (gDNA) was isolated from the yeast colonies using the lithium acetate SDS method (Lõoke et al., 2011). As template for the PCR, 5 µl from the gDNA suspension was used. In the PCR, a forward (SEQ ID NO: 18) and reverse (SEQ ID NO: 19) primer were used to amplify DNA by a method known by the person skilled in the art. The resulting PCR fragments were cleaned and concentrated using the DNA Clean & Concentrator™-5 kit (distributed by Baseclear Lab Products, Leiden, the Netherlands), according to manufacturer's instructions. Using the forward (SEQ ID NO: 18) primer a sequencing reaction was performed and data was analyzed using methods known by the person skilled in the art. When the all-in-one vectors pCSN030 or pCSN031, which express a human codon pair optimized CAS9 gene from the *S. cerevisiae* TEF1 promoter, or when the all-in-one vectors pCSN032 or pCSN033, which express a *S. cerevisiae* codon pair optimized CAS9 gene promoter from the *K. lactis* 11 promoter, or when the all-in-one vectors pCSN034 or pCSN035, which express a *S. cerevisiae* codon pair optimized CAS9 gene promoter from the TDH3 promoter, were transformed together with the DS oligonucleotide donor (FIG. 7), sequences were found in which the expected mutations in genomic DNA were introduced: the G to T mutation at position 190 (introduction of stop codon) in combination with the C to A mutation (mutation of PAM sequence) at position 236. These transformants displayed a red color when grown on YEPD agar plates (10 grams per litre of yeast extract, 20 grams per litre of peptone, 10 grams per litre of dextrose, 20 grams per litre of agar), supplemented with either kanamycin or nourseothricin. The red color of the transformants remained when the red transformants were re-streaked on YEPD agar plates (10 grams per litre of yeast extract, 20 grams per litre of peptone, 10 grams per litre of dextrose, 20 grams per litre of agar). Mutation frequencies are depicted in Table 3. The results indicate that the highest percentage of introduction of a double mutation (G190T mutation, C236A mutation) can be reached using vector pCSN032 (Table 1), containing yeast codon optimized CAS9 expressed from the KI11 promoter, containing a KanMX marker on the vector. In addition, sequencing results indicated that the majority of transformants were found in which only the PAM was mutated (C236A mutation). Similar PAM mutation frequencies were found for PCSN030 and pCSN32. In addition, similar PAM mutation frequencies were found for pSCN031 and pCSN033.

oligonucleotides set forward in SEQ ID NO: 16 and SEQ ID NO: 17 were used to generate a double-stranded oligonucleotide as described in the previous example. 100 nanograms of the PCR fragment, 100 nanograms of the SfiI digested pCSN049 vector and 100 nanograms of the double stranded oligonucleotide donor were transformed to *Saccharomyces cerevisiae* strain CEN.PK113-7D. Transformation was performed using the LiAc/SS carrier DNA/PEG method (Gietz and Woods, 2002). Surprisingly, the number of transformants increased from 20 when vector all-in-one vector pCSN032 was transformed (FIG. 7), to approximately 400 when the SfiI digested pCSN049 vector and the gRNA PCR fragment with homology flanks were transformed, together with the DS oligonucleotide donor. Sequencing of a number of transformants showed that the double mutation frequency, i.e. G to T mutation at position 190 in combination with the C to A mutation at position 236 of the ADE2 gene, slightly decreased, whereas mutation frequencies of the PAM were unaffected (Table 4).

TABLE 4

Mutation frequencies using CAS9 all-in-one expression vectors. Double mutation frequencies indicate the G190T mutation (introduction stop codon) and C236A mutation (mutation PAM). PAM mutation frequency indicates only the C236A mutation.

| CAS9 variant | Promoter | Double mutation frequency KanMX | PAM mutation frequency KanMX |
|---|---|---|---|
| *S. cerevisiae* CPO all in one | KI11p | 31% | 96% |
| *S. cerevisiae* CPO (SfiI), separate gRNA | KI11p | 20% | 95% |

To demonstrate that the guide-RNA PCR fragment was introduced into the SfiI digested vector pCSN049 by in vivo

TABLE 3

Mutation frequencies using CAS9 all-in-one expression vectors. Double mutation frequencies indicate the G190T mutation (introduction stop codon) and C236A mutation (mutation PAM). PAM mutation frequency indicates only the C236A mutation.

| CAS9 variant | Promoter | Double mutation frequency KanMX | PAM mutation frequency KanMX | Double mutation frequency NatMX | PAM mutation frequency NatMX |
|---|---|---|---|---|---|
| Human codon optimized | TEF1p | 5% | 100% | 11% | 66% |
| *S. cerevisiae* CPO | KI11p | 31% | 96% | 12% | 79% |
| *S. cerevisiae* CPO | TDH3p | No red colonies | 67% | 21% | 71% |

Example 3: Increased Yeast Transformation Frequency by In Vivo Recombination of the Guide-RNA into a Pre-Digested 2 Micron Vector Containing a CAS9 Expression Cassette and a Dominant Marker Cassette Vector pCSN049 (FIG. 8) was digested with SfiI. The digested vector was cleaned and concentrated using the DNA Clean & Concentrator™-5 kit (distributed by Baseclear Lab Products, Leiden, the Netherlands). The ADE2.Y guide-RNA sequence (present in SEQ ID NO: 15) was amplified using a forward primer (SEQ ID NO: 20) and a reverse primer (SEQ ID NO: 21). The resulting PCR product contained between 56 and 58 bp overhang with the digested vector pCSN049, as such that it allows in vivo recombination of the PCR fragment and the SfiI digested pCSN049 vector upon transformation of the PCR fragment and the digested vector to yeast (FIG. 9). The single stranded recombination in yeast, a plasmid DNA isolation was performed on a yeast culture (YEPD, 10 grams per litre of yeast extract, 20 grams per litre of peptone, 20 grams per litre of dextrose), overnight 30 degrees Celsius, 250 rpm) of two red colored colonies using the NucleoSpin plasmid kit (Machery Nagel, distributed by Bioké, Leiden, the Netherlands). To efficiently open the yeast cells during the plasmid isolation procedure zymolyase (0.2 U/µl, per cell pellet 50 Units were used, Zymo Research, distributed by Baseclear Lab Products, Leiden, the Netherlands) was added to resuspension buffer A1, the cells were incubated with zymolyase for 30 minutes at 37 degrees Celsius. After zymolyase treatment, the plasmid isolation procedure was continued as described in the supplier's manual. Subsequently 2 µl of the isolated plasmid DNA was used for transformation of *E. coli* NEB 10-beta competent cells (High Efficiency, New England Biolabs, distributed by Bioké, Leiden, the Netherlands). The heatshock, 30 seconds at 42 degrees Celsius, was followed by recovery of the cells in 250 µl SOC medium (supplied with the competent cells by New England Biolabs, distributed by Bioké, Leiden, the Netherlands) and the transformation mixture was plated on 2×TY agar plates (16 grams per litre tryptone peptone, 10 grams per litre yeast extract, 5 grams per litre NaCl, 15 grams per litre granulated agar) supplemented with 100 ug/ml ampicillin (Sigma-Aldrich, Zwijndrecht, the Netherlands). Plates were incubated overnight at 37 degrees Celsius. The resulting E. coli transformants were grown in 2×TY (16 grams per litre tryptone peptone, 10 grams per litre yeast extract, 5 grams per litre NaCl)+100 ug/ml ampicillin (Sigma-Aldrich, Zwijndrecht, the Netherlands) overnight at 37 degrees Celsius 250 rpm and subsequently cells were used for plasmid isolation using the NucleoSpin plasmid kit (Machery Nagel, distributed by Bioké, Leiden, the Netherlands) according to supplier's manual. Resulting plasmid DNA was digested using SacII to excise the inserted ADE2.Y gRNA sequence of 394 bp from the plasmid. Analysis of the fragments on a 0.8% agarose gel showed that the correct band sizes were identified, indicating that the guide-RNA PCR fragment was introduced in the SfiI digested plasmid pCSN049 by in vivo recombination in yeast.

Example 4: Use of all-in-One Vector to Introduce Mutations in One or Two Alleles in a Diploid Yeast Strain Vector pCSN028 (FIG. 10, SEQ ID NO: 24) was constructed by DNA2.0 (Menlo Park, Calif., USA). This 2µ vector expresses CAS9 from Streptococcus pyogenes with an additional C-terminal fusion with a SV40 nuclear localization signal (Mali et al., 2013), it contains a selection marker to confer resistance against G418 and a guide-RNA cassette to target CAS9 to the HXT2 gene of Saccharomyces cerevisiae (SEQ ID NO: 25). In order to introduce an amino acid mutation in the HXT2 protein (N361T), the following mutations were introduced into the genomic DNA, being A1082C, C1083A and in addition a silent point mutation in the PAM was introduced (C1104A), in order to avoid the CAS9 protein from cleaving the DS oligonucleotide donor sequence. To introduce the desired mutations in the HXT2 gene of S. cerevisiae, a DS oligonucleotide was designed (FIG. 11). The single stranded oligonucleotide sequences of SEQ ID NO: 26 and SEQ ID NO: 27 were used to generate a double-stranded oligonucleotide as described in a previous example. The haploid Saccharomyces cerevisiae strain CEN.PK113-7D (MATa URA3 HIS3 LEU2 TRP1 MAL2-8 SUC2) was transformed using the LiAc/SS carrier DNA/PEG method (Gietz and Woods, 2002). In the transformation mixture 250 nanograms vector pCNS028 were transformed together with 250 nanograms of the double stranded oligonucleotide donor (see FIG. 11). Transformation mixtures were plated on YPD-agar (10 grams per litre of yeast extract, 20 grams per litre of peptone, 20 grams per litre of dextrose, 20 grams per litre of agar) containing 200 µg G418 (Sigma Aldrich) per ml. After two to four days of growth at 30° C., colonies appeared on the plates.

Next, a PCR and subsequent sequencing were performed to identify the introduced mutations in the transformants. Genomic gDNA (gDNA) was isolated from the yeast colonies using the lithium acetate SDS method (Lõoke et al., 2011). As template for the PCR 5 µl from this gDNA suspension was used. In the PCR, a forward (SEQ ID NO: 28) and reverse (SEQ ID NO: 29) primer were used to amplify DNA by a method known by the person skilled in the art. The resulting PCR fragments were cleaned and concentrated using the DNA Clean & Concentrator™-5 kit (distributed by Baseclear Lab Products, Leiden, the Netherlands), according to manufacturer's instructions. Using the forward (SEQ ID NO: 28) primer a sequencing reaction was performed and data was analyzed using methods known by the person skilled in the art.

Sequencing results (Table 5) indicated that 57% of the transformants contained the desired mutation in the HXT2 gene (A1082C, C1083A for N361T amino acid change) in combination with the silent PAM mutation (C1104A). These results indicate that an all-in-one vector, containing both CAS9 and guide-RNA, can be used for introduction of point mutations in order to achieve one, or more, amino acid changes.

TABLE 5

Mutation frequencies using a CAS9 all-in-one expression vector in order introduce point mutations (A1082C, C1083A) in genomic DNA of haploid S. cerevisiae strain CEN.PK113-7D, resulting in an amino acid change (N361T) in the Hxt2 protein of strain. In addition a silent mutation in the PAM sequence (C1104A) was introduced in order to avoid the CAS9 protein from cleaving the DS oligonucleotide donor sequence.

| CAS9 variant | Promoter | PAM mutation | HXT2 mutation (in combination with PAM mutation) |
|---|---|---|---|
| S. cerevisiae CPO | KI11p | 100% | 57% |

The diploid Saccharomyces cerevisiae strain CEN.PK2 (MATa/a ura3-52/ura3-52 trp1-289/trp1-289 leu2-3_112/leu2-3_112 his3 Δ1/his3 Δ1 MAL2-8C/MAL2-8C SUC2/SUC2) was transformed using the LiAc/SS carrier DNA/PEG method (Gietz and Woods, 2002). Transformation and subsequent analysis was performed as described previously herein. Table 6 depicts the mutation frequency results in the diploid CEN.PK2 strain. In 67% of the transformants analyzed by sequencing, it was found that the mutation in the PAM sequence (C1104A) was introduced. In 17% of the transformants, one HXT2 allele was mutated (A1082C, C1083A) in combination with the PAM mutation (C1104A). In 17% of the transformants, two HXT2 alleles were mutated (A1082C, C1083A) in combination with the PAM mutation (C1104A). A graphic representation of the sequencing results is given in FIG. 12, which can be used to distinguish between mutations in one or two alleles of the HXT2 gene of the diploid CEN.PK2 strain. These results indicate that an all-in-one vector, containing both CAS9 and guide-RNA, can be used for introduction of point mutations in order to achieve one, or more, amino acid changes. In addition, this type of

TABLE 6

Mutation frequencies using a CAS9 all-in-one expression vector in order introduce point mutations (A1082C, C1083A) in genomic DNA of diploid *S. cerevisiae* strain CEN.PK2, resulting in an amino acid change (N361T) in the Hxt2 protein of strain. In addition a silent mutation in the PAM sequence (C1104A) was introduced in order to avoid the CAS9 protein from cleaving the DS oligonucleotide donor sequence. Mutation frequencies of the HXT2 gene of one or two alleles present in the diploid strain are indicated.

| CAS9 variant | Promoter | PAM mutation | One HXT2 allelle mutated (in combination with PAM mutation) | Two HXT2 allelles mutated (in combination with PAM mutation) |
| --- | --- | --- | --- | --- |
| *S. cerevisiae* CPO | KI11p | 67% | 17% | 17% |

Example 5: Deletion of Up to 10 kb of Genomic DNA Using CRISPR/CAS9

An INT1A guide-RNA sequence that directs the CAS9 protein to the INT1A integration site was cloned into vector pCSN049 (Table 1) using SacII. For this purpose, a synthetic cassette as set out in SEQ ID NO: 30 consisting of the SNR52p RNA polymerase III promoter, the INT1A guide-sequence (TATTAGAACCAGGGAGGTCC; SEQ ID NO: 68), the gRNA structural component and the SUP4 3' flanking region, two SacII restriction sites and sequences homologous to vector pRS426 was synthesized by DNA2.0 (Menlo Park, Calif., USA). This resulted in construction of all-in-one CAS9+ guide-RNA expression vector pCSN038 (containing a KanMX marker). When this vector is transformed to *S. cerevisiae*, the CAS9 protein is directed to the so called INT1A locus, which is located in a non-coding region of yeast genomic DNA of *S. cerevisiae* stain CEN.PK113-7D between the open reading frames NRT1 (YOR071c) and GYP1 (YOR070c), located at 659 bp downstream of the stop codon of NRT1 and 997 bp upstream of the start codon of GYP1 on chromosome XV.

To achieve deletion up to approximately 10000 bases (10 kb) from genomic DNA of *S. cerevisiae* strain CEN.PK113-7D around the INT1A locus, plasmid pCSN038 is transformed together with donor DNA sequences, as schematically depicted in FIG. 13. Transformations are performed using the LiAc/SS carrier DNA/PEG method (Gietz and Woods, 2002). Deletion of 10 kb of genomic DNA around the INT1A integration site (5 kb upstream, 5 kb downstream) is expected to result in viable transformants, because no essential genes are fully or partially removed from the genomic DNA (source *Saccharomyces* genome database, yeastgenome.org). Deletion of a 1 kb fragment is exemplified below, but this procedure can be used as well for the 3 kb, 10 kb and control deletions (see Table 7 for primer combinations). PCR fragment 1, containing 500 bp homology with genomic DNA (5'flank B), is generated using the oligonucleotide sequences as set out in SEQ ID NO: 35 and SEQ ID NO: 36 using genomic DNA isolated from *S. cerevisiae* strain CEN.PK113-7D as template (genomic DNA is isolated according to the method described by Lõoke et al). PCR fragment 2, containing the RFP expression cassette, is generated using the oligonucleotide sequences as set out in SEQ ID NO: 47 and SEQ ID NO: 48, using SEQ ID NO:49 as template (a synthetic DNA cassette synthesized by DNA 2.0, Menlo Park, Calif., USA). PCR fragment 3, containing 500 bp homology with genomic DNA (3'flank B), is generated using the oligonucleotide sequences as set out in SEQ ID NO: 37 and SEQ ID NO: 38 using genomic DNA isolated from *S. cerevisiae* strain CEN.PK113-7D as template (genomic DNA is isolated according to the method described by Lõoke et al). Due to the presence of connector sequences, the 3' part of PCR fragment 1 has homology with the 5' part of PCR fragment 2, and the 5' part of PCR fragment 3 has homology with the 3' part of fragment 2, which allows homologous recombination in the yeast *Saccharomyces cerevisiae* as is described in WO2013144257A1. Because CAS9 is targeted to the INT1A sequence present in the genomic DNA, a double strand break is introduced. The presence of homologous sequences will promote homologous recombination, and thus repair of the double stranded break.

Transformation of fragment 1 (5'flank A), 2 (RFP) and 3 (3'flank A) results in the introduction of RFP at the INT1A integration site. Transformation of fragment 1 (5'flank B), 2 (RFP) and 3 (3'flank B) results in the introduction of RFP and deletion of approximately 1 kb of the genomic DNA sequence. Transformation of fragment 1 (5'flank C), 2 (RFP) and 3 (3'flank C) results in the introduction of RFP and deletion of approximately 3 kb of the genomic DNA sequence. Transformation of fragment 1 (5'flank D), 2 (RFP) and 3 (3'flank D) results in the introduction of RFP and deletion of approximately 10 kb of the genomic DNA sequence. Correct integration of the PCR fragments and desired deletion of the parts of genomic DNA is determined by sequencing or PCR.

The above mentioned transformation are performed in *Saccharomyces cerevisiae* strain CEN.PK113-7D. Transformation was performed using the LiAc/SS carrier DNA/PEG method (Gietz and Woods, 2002). Transformation mixtures were plated on YPD-agar (10 grams per litre of yeast extract, 20 grams per litre of peptone, 20 grams per litre of dextrose, 20 grams per litre of agar) containing 200 μg G418 (Sigma Aldrich) per ml. After two to four days of growth at 30° C., red colored colonies appeared on the plates.

TABLE 7

Overview of PCR primers used to generate the PCR fragments used to delete up to 10 kb of genomic DNA surrounding the INT1A integration site (see FIG. 13).

| Deletion | Flanks | Fragment 1 (5'flank) | Fragment 2 (RFP) | Fragment 3 (3'flank) |
| --- | --- | --- | --- | --- |
| Control* | A | SEQ ID NO: 31 | SEQ ID NO: 47 | SEQ ID NO: 33 |
| | | SEQ ID NO: 32 | SEQ ID NO: 48 | SEQ ID NO: 34 |

TABLE 7-continued

Overview of PCR primers used to generate the PCR fragments used to delete up to 10 kb of genomic DNA surrounding the INT1A integration site (see FIG. 13).

| Deletion | Flanks | Fragment 1 (5'flank) | Fragment 2 (RFP) | Fragment 3 (3'flank) |
|---|---|---|---|---|
| 1 kb | B | SEQ ID NO: 35 | SEQ ID NO: 47 | SEQ ID NO: 37 |
|  |  | SEQ ID NO: 36 | SEQ ID NO: 48 | SEQ ID NO: 38 |
| 3 kb | C | SEQ ID NO: 39 | SEQ ID NO: 47 | SEQ ID NO: 41 |
|  |  | SEQ ID NO: 40 | SEQ ID NO: 48 | SEQ ID NO: 42 |
| 10 kb | D | SEQ ID NO: 43 | SEQ ID NO: 47 | SEQ ID NO: 45 |
|  |  | SEQ ID NO: 44 | SEQ ID NO: 48 | SEQ ID NO: 46 |

*In the control, flanks A are used, which recombine just at the 5' and 3' of the double-strand break introduced.

These results indicate that up to 10 kb of genomic DNA can be removed using CRISPR/CAS9 to introduce one double strand break and by marker-free introduction of an RFP cassette using a homologous recombination approach as described in WO2013144257A1, by using flank sequences that are located up to 5 kb 5' and 3' relatively to the INT1A site.

Alternatively, another approach is used, as described below and illustrated in FIG. 13. Instead of using one guide-RNA cassette, that targets one genomic target (INT1A GT), two different guide-RNA cassettes are expressed from an all-in-one plasmid, as is illustrated in FIG. 14. The guide-RNA cassettes consist of a SNR52p, followed by a guide-sequence, followed by a gRNA structural component, followed by a SUP4 3' flanking region. The two guide-RNA cassettes, with different guide-sequences, are positioned in opposite orientations on the all-in-one plasmid, in order to prevent potential out-recombination of DNA due to the presence of homologous sequences. Transformation of such a plasmid in yeast results in different pairs of double strand breaks that are introduced by expression of 2 different guide-RNA's in combination with expression of CAS9, as illustrated in FIG. 13.

To achieve deletion of approximately 1000 bases (1 kb) from genomic DNA of *S. cerevisiae* strain CEN.PK113-7D around the INT1A locus, the plasmid containing 2 guide-RNA cassettes is transformed together with donor DNA PCR fragments, as schematically depicted in FIG. 13. GT INT1B 5' (SEQ ID NO: 56) targets CAS9 to approximately 500 bp upstream of INT1A and INT1B 3' (SEQ ID NO: 57) targets CAS9 to approximately 500 bp downstream of INT1A, which in combination with fragments 1, 2 and 3 with flanks B (Table 7) results in DNA deletion of approximately 3 kB from genomic DNA of CEN.PK113-7D.

To achieve deletion of approximately 3000 bases (3 kb) from genomic DNA of *S. cerevisiae* strain CEN.PK113-7D around the INT1A locus, the plasmid containing 2 guide-RNA cassettes is transformed together with donor DNA PCR fragments, as schematically depicted in FIG. 13. GT INT1C 5' (SEQ ID NO: 58) targets CAS9 to approximately 1500 bp upstream of INT1A and INT1C 3' (SEQ ID NO:59) targets CAS9 to approximately 1500 bp upstream of INT1A, which in combination with fragments 1, 2 and 3 with flanks C (Table 7) results in DNA deletion of approximately 3 kB fragment from genomic DNA of CEN.PK113-7D.

To achieve deletion of approximately 10000 bases (10 kb) from genomic DNA of *S. cerevisiae* strain CEN.PK113-7D around the INT1A locus, the plasmid containing 2 guide-RNA cassettes is transformed together with donor DNA PCR fragments, as schematically depicted in FIG. 13. GT INT1D 5' (SEQ ID NO: 60) targets CAS9 to approximately 5000 bp upstream of INT1A and INT1D 3' (SEQ ID NO: 59) targets CAS9 to approximately 5000 bp upstream of INT1A, which in combination with fragments 1, 2 and 3 with flanks D (Table 7) results in DNA deletion of approximately 10 kB fragment from genomic DNA of CEN.PK113-7D.

The above mentioned transformation are performed in *Saccharomyces cerevisiae* strain CEN.PK113-7D. Transformation was performed using the LiAc/SS carrier DNA/PEG method (Gietz and Woods, 2002). Transformation mixtures were plated on YPD-agar (10 grams per litre of yeast extract, 20 grams per litre of peptone, 20 grams per litre of dextrose, 20 grams per litre of agar) containing 200 μg G418 (Sigma Aldrich) per ml. After two to four days of growth at 30° C., red colored colonies appeared on the plates. These results indicate that up to 10 kb of genomic DNA can be removed using CRISPR/CAS9 to introduce two double strand break and by marker-free introduction of an RFP cassette using a homologous recombination approach as described in WO2013144257A1, by using flank sequences that are located up to 5 kb 5' and 3' relatively to the INT1A site.

Example 6: Multiplex Use of an all in One Vector Containing Two Guide Sequences (Guide-Sequences for INT1A and ADE2 Locus)

In order to introduce two simultaneous modifications, i.e. introducing a point mutation at the ADE2 locus and marker-free introduction of a Green Fluorescent Protein (GFP) cassette, the following approach is taken. An all-in-one expression vector named pCSN021 is constructed by DNA 2.0 (Menlo Park, Calif., USA) that contains a CAS9 expression cassette, two guide-RNA cassettes containing the ADE2.Y (SEQ ID NO: 65) and the INT1A (SEQ ID NO: 66 guide-RNA cassettes. Plasmid pCNS021 is illustrated in FIG. 14 and set out in SEQ ID NO: 50. The two guide-RNA cassettes, with different guide-sequences, are positioned in opposite orientations on the plasmid, in order to prevent potential out-recombination of DNA due to the presence of homologous sequences in case the two guide-RNA cassettes are positioned in the same orientation in the all-in-one plasmid. Plasmid pSCN021 is transformed together with the ADE2.Y double stranded donor DNA to introduce point mutations resulting in red colored colonies (wiki.yeastgenome.org) and three PCR fragments to introduce a GFP cassette at the INT1A locus as described below.

To introduce the G to T mutation at nucleotide position 190 and an additional C to A mutation at position 236 (FIG. 7) in the ADE2 gene, the ADE2.Y double stranded donor DNA, consisting of SEQ ID NO: 16 and SEQ ID NO: 17, is obtained as described in example 2. To introduce a GFP cassette at the INT1A locus, a first PCR fragment (1), containing 500 bp homology with genomic DNA (5'flank A), is generated using the oligonucleotide sequences as set out in SEQ ID NO: 32 and SEQ ID NO: 33 using genomic DNA isolated from *S. cerevisiae* strain CEN.PK113-7D as template (genomic DNA is isolated according to the method described by Lõoke et al). A second PCR fragment (2), containing the GFP cassette, is generated using the oligonucleotide sequences as set out in SEQ ID NO: 52 and SEQ ID NO: 53, using SEQ ID NO: 51 as template (a synthetic DNA cassette synthesized by DNA 2.0, Menlo Park, Calif., USA). A third PCR fragment (3), containing 500 bp homology with genomic DNA (3'flank B), is generated using the oligonucleotide sequences as set out in SEQ ID NO: 34 and SEQ ID NO: 35 using genomic DNA isolated from *S. cerevisiae* strain CEN.PK113-7D as template (genomic DNA is isolated by a method according to the method described by Lõoke et al). Due to the presence of connector sequences, the 3' part of PCR fragment 1 has homology with the 5' part of PCR fragment 2, and the 5' part of PCR fragment 3 has homology with the 3' part of fragment 2, which allows homologous recombination in the yeast *Saccharomyces cerevisiae* as is described in WO2013144257A1.

The above mentioned transformation are performed in *Saccharomyces cerevisiae* strain CEN.PK113-7D. Transformation was performed using the LiAc/SS carrier DNA/PEG method (Gietz and Woods, 2002). Transformation mixtures were plated on YPD-agar (10 grams per litre of yeast extract, 20 grams per litre of peptone, 20 grams per litre of dextrose, 20 grams per litre of agar) containing 200 µg G418 (Sigma Aldrich) per ml. After two to four days of growth at 30° C., red colored colonies appeared on the plates. In addition, the red colored colonies also display a green color when examined under a fluorescence microscope (using a method known by the person skilled in the art). Introduction of the desired point mutations in the ade2 locus is confirmed by sequencing. Correct integration of the PCR fragments and desired deletion of the parts of genomic DNA is determined by sequencing or PCR.

Example 7: Expression of CAS9 from a Plasmid, Guide-RNA as PCR Fragment and DNA Donor Sequences being Part of the Guide-RNA PCR Fragment In example 2, a double strands (DS) oligonucleotide was designed to introduce the G to T mutation at nucleotide position 190, and an additional C to A mutation at position 236 (FIG. 7) at the ADE2 of CEN.PK113-7D when transformed together with plasmid pCSN049 (FIG. 8) resulting in red colored colonies (wiki.yeastgenome.org). In this example plasmid pCSN049 (expressing CAS9, presence of a KanMX marker) was transformed together with the ADE2.Y guide-RNA cassette that was fused to the donor DNA sequence as illustrated in FIG. 16. The donor DNA sequence is depicted in FIG. 7. The ADE2.Y guide-RNA cassette consists of SNR52p RNA polymerase III promoter, the ADE2.Y guide-sequence (ACTTGAAGATTCTTTAGTGT; SEQ ID NO: 67), the gRNA structural component and the SUP4 3' flanking region. The ADE2.Y guide-RNA sequence may be directly fused to the donor DNA sequence or it can be separated by the 20 bp ADE2.Y guide sequence and a PAM sequence. The latter approach should result in cleaving off the donor DNA sequence from the ADE2.Y guide-RNA sequence. The donor DNA that integrates into the ADE2 locus in order to introduce the desired point mutations (G to T mutation at nucleotide position 190, and an additional C to A mutation at position 236) integrates into the genomic DNA by double cross over (FIG. 16).

To transform ADE2.Y guide-RNA-donor DNA as PCR fragment, a gBlock of which the sequence is set out in SEQ ID NO: 62 was synthesized (Integrated DNA Technologies, Leuven, Belgium). In order to obtain a PCR fragment with sufficient DNA for transformation, primers as set out in SEQ ID NO: 54 and SEQ ID NO: 63 were used in a PCR, using SEQ ID NO: 62 as template. The PCR reaction was performed by using a method known by a person skilled in the art.

To transform ADE2.Y guide-RNA-PAM-ADE2 GT-donor DNA as PCR fragment, a gBlock of which the sequence is set out in SEQ ID NO: 64 was synthesized (Integrated DNA Technologies, Leuven, Belgium). In order to obtain a PCR fragment with sufficient DNA for transformation, primers as set out in SEQ ID NO: 54 and SEQ ID NO: 63 were used in a PCR, using SEQ ID NO: 64 as template. The PCR reaction was performed by using a method known by a person skilled in the art.

Transformation of plasmid pCSN049 and guide-RNA-donor sequences fusions and further selection of correct transformants was performed as described above in Example 2. Red coloured colonies were found on the transformation plates using the approach where the guide-RNA was directly fused to the donor DNA (transformation of a PCR fragment containing SEQ ID NO: 62), as well as using the approach where the guide-RNA and donor DNA was separated by a PAM and ADE2.Y guide-sequence (transformation of a PCR fragment containing SEQ ID NO: 64), which is illustrated in FIG. 16. The results demonstrated that the guide-RNA was functional, when transformed as a PCR fragment and directly fused to the DNA donor sequence, or separated by a PAM and genomic target sequence. Genomic DNA was isolated from a red colored colony, a sequencing reaction was performed to confirm the intended mutations, G to T mutation at nucleotide position 190, and an additional C to A mutation at position 236) in the ADE2 gene (data not shown). The sequencing results demonstrated that the donor DNA integrated into genomic DNA using both approaches as described above and depicted in FIG. 16.

Example 8: Deletion of Up to 10 kb of Genomic DNA Using CRISPR/CAS9 by Targeting CAS9 to One Genomic Target An INT1 guide-RNA sequence that directs the CAS9 protein to the INT1 integration site was cloned into vector pCSN049 (Table 1) using SacII. For this purpose, a synthetic cassette as set out in SEQ ID NO: 30 consisting of the SNR52p RNA polymerase III promoter, the INT1 guide-sequence (TATTAGAACCAGGGAGGTCC; SEQ ID NO: 68), the gRNA structural component and the SUP4 3' flanking region, two SacII restriction sites and sequences homologous to vector pRS426 was synthesized by DNA2.0 (Menlo Park, Calif., USA). This resulted in construction of all-in-one CAS9+ guide-RNA expression vector pCSN038 (containing a KanMX marker). When this vector is transformed to *S. cerevisiae*, the CAS9 protein is directed to the so called INT1 locus, which is located in a non-coding region of yeast genomic DNA of *S. cerevisiae* strain CEN.PK113-7D between the open reading frames NRT1 (YOR071c) and GYP1 (YOR070c), located at 659 bp downstream of the stop codon of NRT1 and 997 bp upstream of the start codon of GYP1 on chromosome XV.

To achieve deletion up to approximately 10000 bases (10 kb) from genomic DNA of *S. cerevisiae* strain CEN.PK113-7D around the INT1 locus, plasmid pCSN038 was transformed together with donor DNA sequences, as schematically depicted in FIG. 17. Transformations were performed using the LiAc/SS carrier DNA/PEG method (Gietz and Woods, 2002). Deletion of 10 kb of genomic DNA around the INT1 integration site (5 kb upstream, 5 kb downstream) was expected to result in viable transformants, because no essential genes were fully or partially removed from the genomic DNA (source Saccharomyces genome database, yeastgenome.org). Deletion of a 3 kb or 10 kb fragment is exemplified below, but this procedure can be used as well for the 1 kb and control (integration at the INT1 integration site) deletions (see Table 8 for primer combinations). PCR fragment 1, containing 500 bp homology with genomic DNA (5'flank C), was generated using the oligonucleotide sequences as set out in SEQ ID NO: 39 and SEQ ID NO: 40 using genomic DNA isolated from S. cerevisiae strain CEN.PK113-7D as template (genomic DNA is isolated according to the method described by Lõoke et al). PCR fragment 2, containing the red fluorescent protein (RFP) expression cassette, was generated using the oligonucleotide sequences as set out in SEQ ID NO: 47 and SEQ ID NO: 48, using SEQ ID NO: 49 as template (a synthetic DNA cassette synthesized by DNA 2.0, Menlo Park, Calif., USA). PCR fragment 3, containing 500 bp homology with genomic DNA (3'flank C), was generated using the oligonucleotide sequences as set out in SEQ ID NO: 41 and SEQ ID NO: 42 using genomic DNA isolated from S. cerevisiae strain CEN.PK113-7D as template (genomic DNA is isolated according to the method described by Lõoke et al). PCR reactions were performed by methods known by the person skilled in the art. Due to the presence of connector sequences, the 3' part of PCR fragment 1 has homology with the 5' part of PCR fragment 2, and the 5' part of PCR fragment 3 has homology with the 3' part of fragment 2, which allows homologous recombination into the genome of the yeast Saccharomyces cerevisiae as is described in WO2013144257A1. Because CAS9 was targeted to the INT1 sequence present in the genomic DNA, a double strand break is introduced. The presence of homologous sequences will promote homologous recombination, and thus repair of the double stranded break.

Transformations were performed in Saccharomyces cerevisiae strain CEN.PK113-7D. Transformation was performed using the LiAc/SS carrier DNA/PEG method (Gietz and Woods, 2002). Transformation mixtures were plated on YPD-agar (10 grams per litre of yeast extract, 20 grams per litre of peptone, 20 grams per litre of dextrose, 20 grams per litre of agar) containing 200 μg G418 (Sigma Aldrich) per ml. After two to four days of growth at 30° C., colonies (red colored and some white colored) appeared on the plates.

Transformation of fragment 1 (5'flank A), 2 (RFP) and 3 (3'flank A) resulted in the introduction of RFP at the INT1 integration site (data not shown). Transformation of fragment 1 (5'flank B), 2 (RFP) and 3 (3'flank B) resulted in the introduction of RFP and deletion of approximately 1 kb of the genomic DNA sequence (data not shown). Transformation of fragment 1 (5'flank C), 2 (RFP) and 3 (3'flank C) resulted in the introduction of RFP and deletion of approximately 3 kb of the genomic DNA sequence (see below). Transformation of fragment 1 (5'flank D), 2 (RFP) and 3 (3'flank D) resulted in the introduction of RFP and deletion of approximately 10 kb of the genomic DNA sequence (see below). Correct integration of the PCR fragments and desired deletion of the parts of genomic DNA is determined by sequencing (data not shown) and PCR (data shown below).

TABLE 8

Overview of PCR primers used to generate the PCR fragments used to delete up to 10 kb of genomic DNA surrounding the INT1 integration site (see FIG. 13).

| Deletion | Flanks | Fragment 1 (5'flank) | Fragment 2 (RFP) | Fragment 3 (3'flank) |
|---|---|---|---|---|
| Control* | A | SEQ ID NO: 31 | SEQ ID NO: 47 | SEQ ID NO: 33 |
|  |  | SEQ ID NO: 32 | SEQ ID NO: 48 | SEQ ID NO: 34 |
| 1 kb | B | SEQ ID NO: 35 | SEQ ID NO: 47 | SEQ ID NO: 37 |
|  |  | SEQ ID NO: 36 | SEQ ID NO: 48 | SEQ ID NO: 38 |
| 3 kb | C | SEQ ID NO: 39 | SEQ ID NO: 47 | SEQ ID NO: 41 |
|  |  | SEQ ID NO: 40 | SEQ ID NO: 48 | SEQ ID NO: 42 |
| 10 kb | D | SEQ ID NO: 43 | SEQ ID NO: 47 | SEQ ID NO: 45 |
|  |  | SEQ ID NO: 44 | SEQ ID NO: 48 | SEQ ID NO: 46 |

*In the control, flanks A are used, which recombine just at the 5' and 3' of the double-strand break introduced, to integrate the RFP expression cassette at the INT1 locus.

By UV light (Qpix 450 Colony Picker—Molecular devices LLC) a discrimination was made between red fluorescent colonies, indicating RFP integration, and white colonies, indicating no RFP integration, that appeared on the plates. For each transformation a set of white and red colonies was selected and checked by PCR for presence of RFP (red) and the deleted part of the genomic DNA as is intended. Genomic DNA is isolated according to the method described by Lõoke et al and is used as template in a PCR reaction. The design of the primers for the PCR to confirm the integration of RFP in to the genome and deletion of genomic DNA surrounding the INT locus is schematically depicted in FIG. 18. The SEQ ID NO's od of the primers used are depicted in Table 9. Primerset F1-R1 and F2-R2 was used to confirm the integration of the RFP expression unit at the correct location in the genome and primerset F3-R3 was used to confirm the deletion.

TABLE 9

Primers used to confirm correct integration of the RFP into the INT1 locus and to confirm deletion of 1, 3 or 10 kb of genomic DNA.

| Primers | F1-R1 (confirm correct integration at 5' end) | F2-R2 (confirm correct integration at 3' end) | F3-R3 (confirm deletion) |
|---|---|---|---|
| Control (integration RFP at INT1 locus) | SEQ ID NO: 131 SEQ ID NO: 133 | SEQ ID NO: 134 SEQ ID NO: 132 | SEQ ID NO: 31 SEQ ID NO: 34 |
| 1 kb deletion | SEQ ID NO: 129 SEQ ID NO: 133 | SEQ ID NO: 134 SEQ ID NO: 130 | SEQ ID NO: 35 SEQ ID NO: 38 |
| 3 kb | SEQ ID NO: 127 | SEQ ID NO: 134 | SEQ ID NO: 39 |

TABLE 9-continued

Primers used to confirm correct integration of the RFP into the INT1 locus and to confirm deletion of 1, 3 or 10 kb of genomic DNA.

| Primers | F1-R1 (confirm correct integration at 5' end) | F2-R2 (confirm correct integration at 3' end) | F3-R3 (confirm deletion) |
|---|---|---|---|
| deletion | SEQ ID NO: 133 | SEQ ID NO: 128 | SEQ ID NO: 42 |
| 10 kb deletion | SEQ ID NO: 125 | SEQ ID NO: 134 | SEQ ID NO: 43 |
| | SEQ ID NO: 133 | SEQ ID NO: 126 | SEQ ID NO: 46 |

The results of the PCR confirming deletion of 3 kb genomic DNA and integration of RFP at the INT1 locus is displayed in FIG. 19 and is representative for the control, 1 kb and 10 kb deletion. In lanes 2-5 the PCR the presence of the RFP gene (oligoset F3R3, 2800 bp fragment) in red fluorescent colonies is depicted. Replacement (deletion) of 3 kB of the genomic DNA was confirmed by sequencing (data not show). In lanes 6-9 the absence of the RFP gene in the white colonies (oligoset F3R3, 4211 bp, lanes 6-9) is confirmed. In the white colored colonies, no gene editing by integration of RFP occurred. As a negative control genomic DNA of S. cerevisiae strain CEN-PK113.7D was included to demonstrate amplification of the PCR fragment when no insertion and deletion of the 3 kb fragment of genomic DNA has occurred (lane 1, oligoset F3R3, 4211 bp fragment). For PCR fragment size estimation the 1 kb+ marker (Thermo-Fisher Catno. 10787-018 (M)) was used. The integration of the RFP gene (primerset F3R3, 4211 bp) in red colonies and thereby deletion of 10 kb genomic DNA is displayed in lanes 10-12 of FIG. 19.

The results of the PCR experiments to confirm the correct integration of the RFP expression cassettes at the desired loci to obtain 3 or 10 kb deletion of genomic DNA is shown in FIG. 20. In these experiments, 2 independent red fluorescent transformants were further examined using the same genomic DNA as used to confirm deletion of 3 kb and 10 kb genomic DNA (as shown in FIG. 19). In lane 3-4 (5' integration check, oligoset F1R1, 870 bp) and 7-8 (3' integration check, oligoset F2R2, 865 bp) the integration of the RFP gene at the correct location in the genome is demonstrated. The negative milliQ (MQ) and WT (genomic DNA isolated from strain S. cerevisiae CEN.PK113-7D) controls are presented in lanes 2, 6 and 1, 5 respectively. The correct integration of the RFP gene in the genome was also confirmed for deletion of the 10 kb fragment. In lane 11-12 (5' integration, oligoset F1R1, 887 bp) and 15-16 (3' integration, oligoset F2R2, 891 bp) the integration of the RFP gene at the correct location in the genome is displayed. The milliQ (MQ) and WT control (S. cerevisiae CEN.PK113-7D) are presented in lanes 10, 14 and 9, 13 respectively.

The results indicate that up to 10 kb of genomic DNA can be removed using CRISPR/CAS9 to introduce one double strand break and by marker-free introduction of an RFP cassette using a homologous recombination approach as described in WO2013144257A1, by using flank sequences that are located up to 5 kb 5' and 3' relatively to the INT1 site. In this example, up to approximately 10 kb was removed from the genomic DNA. The approach chosen in this example (FIG. 17) would also allow for deletion of larger parts from genomic DNA, by adapting the choice for flank sequences, eventually in combination with another guide RNA.

The presence of a connector 5 sequence at the 5' end of the FRP expression cassette and the presence of a connector 3 sequence at the 3' end of the RFP expression cassette allows for flexibility in choosing the desired integration locus. Any integration site can be targeted by changing the genomic target sequence (that is part of the guide RNA expression cassette) to a desired integration site, while including a specific 5' flank (integration site)-con5 and a specific con3-3' flank (integration site) PCR fragment in the transformation mixture together with the RFP expression cassette, the guide RNA expression cassette present on vector also expression CAS9. Alternatively, the guide RNA expression cassette is present on a separate vector as the CAS9 expression cassette, preferably the guide RNA cassette being present on a multi copy yeast expression vector and the CAS9 expression cassette being present on a single copy yeast expression vector.

Background Information about the Genes Used to Produced Beta-Carotene in S. cerevisiae.

When performing precision genome editing experiments, an easy readout of successful expression or expression levels of genes that were modified or introduced, for example based on a color change of the organisms in which such experiments are performed, is beneficial. When three genes, crtE, crtYB and crtI from *Xanthophyllomyces dendrorhous* are introduced and overexpressed in *Saccharomyces cerevisiae*, the transformants will produce carotenoids which are colored compounds and consequently result in yellow, orange or red colored transformants (Verwaal et al., 2007). Coloring of the cells is a result of carotenoid production and can be achieved either by expressing crtE, crtYB and crtI from a vector, or by integration of the genes into genomic DNA, using promoters and terminators functional in *S. cerevisiae* to express these genes (Verwaal et al., 2007). Examples 9 and 10 demonstrate that by using the CRISPR/CAS9 system of the invention, the three carotenogenic expression cassettes can be transformed into one locus (singleplex) or up to 3 different loci (multiplex) in the genomic DNA of *S. cerevisiae*, resulting in colored transformants, reflecting correctly edited cells.

Example 9: Engineering of One Genomic Target Site (Singleplex)

In this singleplex engineering example the integration of three functional carotenoid gene expression cassettes into one genomic DNA locus of a host organism using CRISPR/CAS9 is demonstrated. The integration of the three functional carotenoid gene expression cassettes being a combination of crtE, crtYB and crtI, enables carotenoid production in the host organism (as illustrated in FIG. 23 and FIG. 24).

pCSN061 Vector Construction (Single Copy Vector, KI11p-CAS9CPO, KanMX Marker)

Yeast vector pCSN061 is a single copy vector (CEN/ARS) that contains a CAS9 expression cassette consisting of a CAS9 codon optimized variant expressed from the Kill promoter (*K. lactis* promoter of KLLA0F20031g) and the *S. cerevisiae* GND2 terminator, and a functional KanMX marker cassette conferring resistance against G418. The sequence of the CAS9 expression cassette is set out in SEQ ID NO: 11) The CAS9 expression cassette was KpnI/NotI ligated into pRS414 (Sikorski and Hieter, 1989), resulting in intermediate vector pCSN004. Subsequently, a functional expression cassette conferring G418 resistance (see euroscarf.de; the KanMX nucleotide sequence is set out in SEQ ID NO: 13) was NotI restricted from vector pUG7-KanMX and NotI ligated into pCSN004, resulting in vector pCSN061 that is depicted in FIG. 21 and the sequence is set out in SEQ ID NO: 135.

pRN1120 Vector Construction (Multi-Copy Guide RNA Expression Vector, NatMX Marker)

Yeast vector pRN1120 is a multi-copy vector (2 micron) that contains a functional NatMX marker cassette conferring resistance against nourseothricin. The backbone of this vector is based on pRS305 (Sikorski and Hieter, 1989), including a functional 2 micron ORI sequence and a functional NatMX marker cassette (see euroscarf.de). The NatMX nucleotide sequence is set out in SEQ ID NO: 14. Vector pRN1120 is depicted in FIG. 22 and the sequence is set out in SEQ ID NO: 136. Vector pRN1120 can be equipped with a guide RNA cassettes as explained in this example. Prior to transformation, vector pRN1120 (FIG. 22) was restricted with the restriction enzymes EcoRI and XhoI. Next, the linearized vector was purified using the Nucleo-Spin Gel and PCR Clean-up kit (Machery-Nagel, distributed by Bioké, Leiden, the Netherlands) according to manufacturer's instructions.

Donor DNA

PCR fragments were used as donor DNA in the singleplex genome engineering experiments. Singleplex engineering in this example means the integration of a set of up to 3 functional carotenoid gene expression cassettes, being a combination of crtE, crtYB and crtI in order to enable carotenoid production, into one locus of *S. cerevisiae* genomic DNA using CRISPR/CAS9. The donor DNA sequences were derived from various sources, as indicated in Table 10. Donor DNA sequences can be expression cassettes (i.e. carotenoid gene expression cassettes) or donor DNA flank sequences (i.e. sequences used to allow integration of the carotenoid gene expression cassettes into the desired locus within the genomic DNA). A description of the different genomic integration sites used is given later in this example.

TABLE 10

Overview of different donor DNA sequences used in the singleplex experiment. Under description, the following elements are indicated: Connector (Con) sequences are 50 bp DNA sequences that are required for *in vivo* recombination as described in WO2013144257A1. The promoter including the relative expected expression strengths (Low p = low strength promoter, Med p = medium strength promoter, Strong p = high strength promoter). Promoters originated from *S. cerevisiae* or *K. lactis*. The *K. lactis* promoter KIYdr1p originated from KLLA0F20031g. The ORF name, crtE, crtYB or crtI, and the terminator sequence (all terminators originate from *S. cerevisiae*). This table includes the SEQ ID NO's of the primers used to obtain the donor DNA sequences by amplification by PCR.

| SEQ ID NO: of donor DNA | Description | Template for PCR | Forward primer | Reverse primer |
| --- | --- | --- | --- | --- |
| SEQ ID NO: 137 | con5 - Low p (KITDH2p) - crtE - ScTDH3t - conA | SEQ ID NO: 137 | SEQ ID NO: 155 | SEQ ID NO: 156 |
| SEQ ID NO: 138 | con5 - Med p (KIPGK1p) - crtE - ScTDH3t - conA | SEQ ID NO: 138 | SEQ ID NO: 155 | SEQ ID NO: 156 |
| SEQ ID NO: 139 | con5-Strong p (ScFBA1p) - crtE - ScTDH3t - conA | SEQ ID NO: 139 | SEQ ID NO: 155 | SEQ ID NO: 156 |
| SEQ ID NO: 140 | conA - Low p (KIYDR1p) - crtYB - ScPDC1t - conB | SEQ ID NO: 140 | SEQ ID NO: 157 | SEQ ID NO: 158 |
| SEQ ID NO: 141 | conA - Med p (KITEF2p) - crtYB - ScPDC1t - conB | SEQ ID NO: 141 | SEQ ID NO: 157 | SEQ ID NO: 158 |
| SEQ ID NO: 142 | conA - Strong p (ScTEF1p) - crtYB - ScPDC1t - conB | SEQ ID NO: 142 | SEQ ID NO: 157 | SEQ ID NO: 158 |
| SEQ ID NO: 143 | conB-Low p (ScPRE3p) - crtI - ScTAL1t - conC | n.a. | n.a. | n.a. |
| SEQ ID NO: 144 | conB - Med p (ScACT1p) - crtI - ScTAL1t - conC | n.a. | n.a. | n.a. |
| SEQ ID NO: 145 | conB-Strong p (KIENO1p) - crtI - ScTAL1t - conC | n.a. | n.a. | n.a. |
| SEQ ID NO: 146 | conB - Low p (ScPRE3p) - crtI - ScTAL1t - con3 | SEQ ID NO: 143 | SEQ ID NO: 159 | SEQ ID NO: 160 |
| SEQ ID NO: 147 | conB - Med p (ScACT1p) - crtI - ScTAL1t - con3 | SEQ ID NO: 144 | SEQ ID NO: 159 | SEQ ID NO: 160 |
| SEQ ID NO: 148 | conB - Strong p (KIENO1p) - crtI - ScTAL1t - con3 | SEQ ID NO: 145 | SEQ ID NO: 159 | SEQ ID NO: 160 |
| SEQ ID NO: 149 | Flank: 5' INT1 - con5 | CEN.PK113-7D genomic DNA | SEQ ID NO: 161 | SEQ ID NO: 162 |
| SEQ ID NO: 150 | Flank: 5' INT59 - con5 | CEN.PK113-7D genomic DNA | SEQ ID NO: 163 | SEQ ID NO: 164 |
| SEQ ID NO: 151 | Flank: 5' YPRCtau3 - con5 | CEN.PK113-7D genomic DNA | SEQ ID NO: 165 | SEQ ID NO: 166 |
| | Flank: con3 - 3' INT1 | CEN.PK113-7D | SEQ ID NO: 167 | SEQ ID |

TABLE 10-continued

Overview of different donor DNA sequences used in the singleplex experiment. Under description, the following elements are indicated: Connector (Con) sequences are 50 bp DNA sequences that are required for *in vivo* recombination as described in WO2013144257A1. The promoter including the relative expected expression strengths (Low p = low strength promoter, Med p = medium strength promoter, Strong p = high strength promoter). Promoters originated from *S. cerevisiae* or *K. lactis*. The *K. lactis* promoter KlYdr1p originated from KLLA0F20031g. The ORF name, crtE, crtYB or crtI, and the terminator sequence (all terminators originate from *S. cerevisiae*). This table includes the SEQ ID NO's of the primers used to obtain the donor DNA sequences by amplification by PCR.

| SEQ ID NO: of donor DNA | Description | Template for PCR | Forward primer | Reverse primer |
|---|---|---|---|---|
| 152 | | genomic DNA | | NO: 168 |
| SEQ ID NO: 153 | Flank: con3 - 3' INT59 | CEN.PK113-7D genomic DNA | SEQ ID NO: 169 | SEQ ID NO: 170 |
| SEQ ID NO: 154 | Flank: con3 - 3' YPRCtau3 | CEN.PK113-7D genomic DNA | SEQ ID NO: 171 | SEQ ID NO: 172 |

N.a. not applicable.

The carotenoid gene expression cassettes which were part of the donor DNA sequences were ordered at DNA 2.0 (Menlo Park, Calif., USA). The sequences are set out in SEQ ID NO: 137 to SEQ ID NO: 145, and were used as template for PCR reactions of which the products were used as donor DNA expression cassettes that were integrated into genomic DNA using the approach described in this example (Vide infra). In this example, a carotenoid gene expression cassette was composed of the following elements:
  (i) at the 5' and 3' positions of the DNA sequence 50 basepair connector sequences are present. The presence of connector sequences allowed in vivo homologous recombination between highly homologous connector sequences that are part of other donor DNA expression cassettes or donor DNA flank sequences as is described in WO2013144257A1. As a result, multiple donor DNA fragments were assembled into the genomic DNA at a desired location and in a desired order, as is depicted in FIG. 23.
  (ii) A promoter sequence, which can be homologous (i.e. from *S. cerevisiae*) or heterologous (e.g. from *Kluyveromyces lactis*) and a terminator sequence derived from *S. cerevisiae*, were used to control the expression of the carotenogenic genes crtE, crtYB or crtI. As described in Table 10, the promoters are expected to have different expression strengths, resulting in low, medium or high expression levels of crtE, crtYB or crtI. In other experiments, the relative expression strengths of the promoters used to express crtE, crtYB and crtI were determined (data not shown).
  (iii) The crtE, crtYB and crtI nucleotide sequences were codon pair optimized for expression in *S. cerevisiae* as described in WO2008/000632.

PCR fragments for the donor DNA expression cassette sequences were generated using Phusion DNA polymerase (New England Biolabs, USA) according to manufacturer's instructions. In case of the expression cassettes of the carotenogenic genes, the synthetic DNA provided by DNA2.0 was used as a template in the PCR reactions, using the specific forward and reverse primer combinations depicted in Table 10. For example, in order to obtain the PCR fragment set out in SEQ ID NO: 137, the synthetic DNA construct provided by DNA2.0 was used as a template, using primer sequences set out in SEQ ID NO: 155 and SEQ ID NO: 156. In total, nine different donor DNA sequences containing the carotenoid gene expression cassettes were generated by PCR, as set out in SEQ ID NO: 137; 138; 139; 140; 141; 142; 146; 147 and 148.

Genomic gDNA (gDNA) was isolated from the yeast strain CEN.PK113-7D (MATa URA3 HIS3 LEU2 TRP1 MAL2-8 SUC2) using the lithium acetate SDS method (Lõoke et al., 2011). Strain CEN.PK113-7D is available from the EUROSCARF collection (euroscarf.de, Frankfurt, Germany) or from the Centraal Bureau voor Schimmelcultures (Utrecht, the Netherlands, entry number CBS 8340). The origin of the CEN.PK family of strains is described by van Dijken et al., 2000the pre.

This genomic DNA was used as a template to obtain the PCR fragments that were used as donor for DNA flanking sequences (comprising the overlap with the genomic DNA for genomic integration), using the specific forward and reverse primer combinations depicted in Table 10. For example, in order to obtain the PCR fragment set out in SEQ ID NO: 149, genomic DNA isolated from strain CEN.PK113-7D was used as a template, using primer sequences set out in SEQ ID NO: 161 and SEQ ID NO: 162. In total, six different donor DNA flank sequences were generated by PCR, as set out in SEQ ID NO: 149; 150; 151; 152; 153; 154. The donor DNA flank sequences contained 50 basepair connector sequences at the 5' or 3' position. The presence of connector sequences allowed in vivo homologous recombination between highly homologous connector sequences that are part of the donor DNA expression cassettes as is described in WO2013144257A1.

All donor DNA PCR fragments were purified using the NucleoSpin Gel and PCR Clean-up kit (Machery-Nagel, distributed by Bioké, Leiden, the Netherlands) according to manufacturer's instructions.

Guide RNA Expression Cassettes and Genomic Target Sequences Guide RNA expression cassettes were ordered as synthetic DNA cassettes (gBlocks) at Integrated DNA Technologies, Leuven, Belgium (for an overview see Table 11). The synthetic guide RNA expression cassettes, of which the sequences are set out in SEQ ID NO: 173, 174 and 175, consisted of the SNR52p RNA polymerase III promoter, a genomic target sequence (SEQ ID NO: 176; 177; 178), the gRNA structural component and the SUP4 3' flanking region as described in DiCarlo et al., 2013. The guide RNA gBlocks contained at their 5' end 78 basepairs homology and at their 3' end 87 bp homology with vector pRN1120 (after restriction of the vector with EcoRI and XhoI). The presence of homologous DNA sequences at the 5' and 3' end of the guide RNA cassette will promote reconstitution of a circular vector in vivo by homologous recombination (gap repair) (Orr-Weaver et al., 1983).

The gBlocks were individually ligated into the pCR-BluntII-TOPO vector (Zero Blunt TOPO PCR Cloning Kit, Life Technologies, Grand Island, N.Y., USA) according to manufacturer's instructions. Using the TOPO vector containing the gBlock as template, Phusion DNA polymerase (New England Biolabs, USA), and the primers as set out in SEQ ID NO: 179 and 180, guide RNA expression cassette PCR fragments were generated according to manufacturer's instructions. All guide RNA expression cassette PCR fragments were purified using the NucleoSpin Gel and PCR Clean-up kit (Machery-Nagel, distributed by Bioké, Leiden, the Netherlands) according to manufacturer's instructions.

TABLE 11

Overview of genomic target and guide RNA sequences used in the singleplex experiment. The guide RNA expression cassettes were used as a template for PCR using the primers indicated in this table in order to obtain guide RNA expression PCR fragments used in the transformation experiments.

| Target | Genomic target SEQ ID NO: | Guide RNA expression cassette | Primers used to amplify guide RNA cassette |
|---|---|---|---|
| INT1 locus | SEQ ID NO: 176 | SEQ ID NO: 173 | SEQ ID NO: 179 SEQ ID NO: 180 |
| INT59 locus | SEQ ID NO: 177 | SEQ ID NO: 174 | SEQ ID NO: 179 SEQ ID NO: 180 |
| YPRCtau3 locus | SEQ ID NO: 178 | SEQ ID NO: 175 | SEQ ID NO: 179 SEQ ID NO: 180 |

Integration Sites

The INT1 integration site is located at the non-coding region between NTR1 (YOR071c) and GYP1 (YOR070c) located on chromosome XV. The INT59 integration site is a non-coding region between SRP40 (YKR092C) and PTR2 (YKR093W) located on chromosome XI. The YPRCtau3 integration site is a Ty4 long terminal repeat, located on chromosome XVI, and has been described by Bai Flagfeldt et al. (2009).

Transformation and Singleplex Engineering

The procedure for the singleplex engineering experiments is depicted in FIG. 23 and FIG. 24. Singleplex engineering in this example means the integration of a set of 3 functional carotenoid gene expression cassettes, being a combination of crtE, crtYB and crtI in order to enable carotenoid production, into one locus of genomic DNA using CRISPR/CAS9. Prior to transformation, DNA concentrations of the donor DNA's, guide RNA expression cassettes and vectors were measured using the NanoDrop (ND-1000 Spectrophotometer, Thermo Scientific).

Vector pSCN061 expressing CAS9 was first transformed to S. cerevisiae strain CEN.PK113-7D (MATa URA3 HIS3 LEU2 TRP1 MAL2-8 SUC2) using the LiAc/salmon sperm (SS) carrier DNA/PEG method (Gietz and Woods, 2002). In the transformation mixture 1 microgram of vector pCNS061 (FIG. 21) was used. The transformation mixture was plated on YPD-agar (10 grams per litre of yeast extract, 20 grams per litre of peptone, 20 grams per litre of dextrose, 20 grams per litre of agar) containing 200 microgram (µg) G418 (Sigma Aldrich, Zwijndrecht, the Netherlands) per ml. After two to four days of growth at 30° C. colonies appeared on the transformation plate.

A yeast colony conferring resistance to G418 on the plate, now referred as strain CSNO01, was inoculated on YPD-G418 medium (10 grams per litre of yeast extract, 20 grams per litre of peptone, 20 grams per litre of dextrose, 200 µg G418 (Sigma Aldrich, Zwijndrecht, the Netherlands) per ml). Subsequently, strain CSNO01 was transformed with the following DNA fragments using the LiAc/SS carrier DNA/PEG method (Gietz and Woods, 2002):

a) Purified linearized vector pRN1120 (1/10 of the molar mass relative to the guide RNA PCR fragment), b) a guide RNA expression cassette (PCR fragment) containing homology at the 5' and 3' end with vector pRN1120 (1 equivalent of a molar mass), c) two donor DNA flank sequences with homology to the integration sites (1/10 of the molar mass relative to the guide RNA PCR fragment), d) three donor DNA gene expression (1/5 of the molar mass relative to the guide RNA PCR fragment).

As explained earlier in this example and in WO2013144257A1, because of the presence of highly homologous 50 bp connector DNA sequences, the donor DNA expression cassettes and donor DNA flank sequences will assemble to one stretch of DNA at the desired location and in the desired order into the genomic DNA as visualized in FIG. 23. The guide RNA expression cassette, which contains 78 bp homology at the 5' and 87 bp homology at the 3' end with vector pRN1120, will assemble into the linearized vector pRN1120 to form a functional circular vector (FIG. 24) by in vivo homologous recombination (gap repair, Orr-Weaver et al., 1983), which allows selection of transformants on nourseothricin.

As shown in Table 12, different transformation experiments were performed to determine the effect of introduction of different carotenoid gene expression cassettes and different genomic integration sites on the efficiency of singleplex CRISPR/CAS9 mediated genome engineering in S. cerevisiae. For example in singleplex experiment #01, strain CSNO01 was transformed with:

a) Purified linearized vector pRN1120 (1/10 of the molar mass relative to the guide RNA PCR fragment), b) a guide RNA expression cassette (PCR fragment, SEQ ID NO: 173) containing homology at the 5' and 3' end with vector pRN1120 (1 equivalent of a molar mass), c) two donor DNA flank sequences (SEQ ID NO: 149 and 152) with homology to the integration sites (1/10 of the molar mass relative to the guide RNA PCR fragment), d) three donor DNA gene expression cassettes (SEQ ID NO: 137; 140 and 146, 1/5 of the molar mass relative to the guide RNA PCR fragment).

In this experiment, CAS9 was targeted to the INT1 locus, and crtE, crtYB and crtI expressed from low strength promoters were targeted to the INT1 locus, where the double stranded break that was introduced by CAS9 was repaired by the transformed donor DNA PCR fragments (FIG. 23).

The transformation mixtures were plated on YPD-agar (10 grams per litre of yeast extract, 20 grams per litre of peptone, 20 grams per litre of dextrose, 20 grams per litre of agar) containing 200 µg nourseothricin (NatMX, Jena Bioscience, Germany) and 200 µg G418 (Sigma Aldrich, Zwijndrecht, the Netherlands) per ml. Alternatively, transformation mixtures were plated on YPD-agar (10 grams per litre of yeast extract, 20 grams per litre of peptone, 20 grams per litre of dextrose, 20 grams per litre of agar) containing only 200 µg nourseothricin (NatMX, Jena Bioscience, Germany) per ml. After two to four days of growth at 30° C., colonies appeared on the transformation plates.

TABLE 12

Overview of transformation experiments performed in the singleplex experiment. In a first transformation vector pCSN061 was transformed. In a second transformation vector pRN1120, restricted with EcoRI and XhoI, was transformed together with 5 donor DNA expression fragments.

| Experiment | Description experiment | Vectors | guide RNA | Donor DNA expression cassettes | Donor DNA flanks |
|---|---|---|---|---|---|
| #01 singleplex | crt cassettes with low strength promoters to INT1 | pSCN061 pRN1120 (restricted with EcoRI and XhoI) | SEQ ID NO: 173 | SEQ ID NO: 137 SEQ ID NO: 140 SEQ ID NO: 146 | SEQ ID NO: 149 SEQ ID NO: 152 |
| #02 singleplex | crt cassettes with medium strength promoters to INT1 | pSCN061 pRN1120 (restricted with EcoRI and XhoI) | SEQ ID NO: 173 | SEQ ID NO: 138 SEQ ID NO: 141 SEQ ID NO: 147 | SEQ ID NO: 149 SEQ ID NO: 152 |
| #03 singleplex | crt cassettes with high strength promoters to INT1 | pSCN061 pRN1120 (restricted with EcoRI and XhoI) | SEQ ID NO: 173 | SEQ ID NO: 139 SEQ ID NO: 142 SEQ ID NO: 148 | SEQ ID NO: 149 SEQ ID NO: 152 |
| #04 singleplex | crt cassettes with low strength promoters to INT59 | pSCN061 pRN1120 (restricted with EcoRI and XhoI) | SEQ ID NO: 174 | SEQ ID NO: 137 SEQ ID NO: 140 SEQ ID NO: 146 | SEQ ID NO: 150 SEQ ID NO: 153 |
| #05 singleplex | crt cassettes with medium strength promoters to INT59 | pSCN061 pRN1120 (restricted with EcoRI and XhoI) | SEQ ID NO: 174 | SEQ ID NO: 138 SEQ ID NO: 141 SEQ ID NO: 147 | SEQ ID NO: 150 SEQ ID NO: 153 |
| #06 singleplex | crt cassettes with high strength promoters to INT59 | pSCN061 pRN1120 (restricted with EcoRI and XhoI) | SEQ ID NO: 174 | SEQ ID NO: 139 SEQ ID NO: 142 SEQ ID NO: 148 | SEQ ID NO: 150 SEQ ID NO: 153 |
| #07 singleplex | crt cassettes with low strength promoters to YPRCtau3 | pSCN061 pRN1120 (restricted with EcoRI and XhoI) | SEQ ID NO: 175 | SEQ ID NO: 137 SEQ ID NO: 140 SEQ ID NO: 146 | SEQ ID NO: 151 SEQ ID NO: 154 |
| #08 singleplex | crt cassettes with medium strength promoters to YPRCtau3 | pSCN061 pRN1120 (restricted with EcoRI and XhoI) | SEQ ID NO: 175 | SEQ ID NO: 138 SEQ ID NO: 141 SEQ ID NO: 147 | SEQ ID NO: 151 SEQ ID NO: 154 |
| #09 singleplex | crt cassettes with high strength promoters to YPRCtau3 | pSCN061 pRN1120 (restricted with EcoRI and XhoI) | SEQ ID NO: 175 | SEQ ID NO: 139 SEQ ID NO: 142 SEQ ID NO: 148 | SEQ ID NO: 151 SEQ ID NO: 154 |
| #10 singleplex | Control transformation, pRN1120 (as circular vector), no guide RNA added | pSCN061 pRN1120 | No guide RNA PCR fragment added | SEQ ID NO: 137 SEQ ID NO: 140 SEQ ID NO: 146 | SEQ ID NO: 149 SEQ ID NO: 152 |
| #11 singleplex | Control transformation, pRN1120 (as linearized vector), no guide RNA added | pSCN061 pRN1120 (restricted with EcoRI and XhoI) | No guide RNA PCR fragment added | SEQ ID NO: 137 SEQ ID NO: 140 SEQ ID NO: 146 | SEQ ID NO: 149 SEQ ID NO: 152 |

The presence of a connector 5 sequence at the crtE expression cassette and the presence of a connector 3 sequence at the crtI expression cassette allows for flexibility in choosing the desired integration locus. Any integration site can be targeted by changing the genomic target sequence (that is part of the guide RNA expression cassette) to a desired integration site, while including a 5' flank (integration site)-con5 and a con3-3' flank (integration site) PCR fragment in the transformation mixture together with the three donor DNA expression cassettes, the guide RNA expression cassette and the linearized vector pRN1120, as illustrated in FIG. 24.

Singleplex Integration Efficiencies

Transformation of crtE, crtYB and crtI expression cassettes resulted in colored transformants, by the integration of the three donor DNA expression cassettes and donor DNA flank sequences that are used to enable targeting to the desired locus into genomic DNA. After transformation, the total number of colonies on a transformation plate were counted. The transformants were colored and/or non-colored. In case of colored transformants, the crtE, crtYB and crtI expression cassettes were successfully integrated into the genomic DNA of the yeast cells. In case of non-colored transformants, crtE, crtYB and crtI expression cassettes were not successfully integrated into the genomic DNA of the yeast cells. The percentage of successfully engineered cells, i.e. transformants that have integrated the crtE, crtYB and crtI expression cassettes into genomic DNA, was calculated by dividing the number of colored transformants by the number of total transformants. The results are indicated in Table 13.

TABLE 13

Percentage colored cells obtained in the different singleplex transformation experiments plated on YPD (2%) + G418 + NatMX agar plates (double selection) to allow selection on both the CAS9 and guide RNA containing vectors or plated on YPD (2%) + NatMX agar plates (single selection) to allow selection on only the guide RNA containing vector.

| Experiment | Description experiment | % Colored cells (double selection) | Number of transformants obtained (double selection) | % Colored cells (single selection) | Number of transformants obtained (single selection) |
|---|---|---|---|---|---|
| #01 singleplex | crt cassettes with low strength promoters to INT1 | 85% | 92 | 77% | 79 |
| #02 singleplex | crt cassettes with medium strength promoters to INT1 | 88% | 44 | 51% | 39 |
| #03 singleplex | crt cassettes with high strength promoters to INT1 | 52% | 11 | 16% | 6 |
| #04 singleplex | crt cassettes with low strength promoters to INT59 | 90% | 76 | 61% | 52 |
| #05 singleplex | crt cassettes with medium strength promoters to INT59 | 93% | 57 | 70% | 48 |
| #06 singleplex | crt cassettes with high strength promoters to INT59 | 90% | 27 | 43% | 20 |
| #07 singleplex | crt cassettes with low strength promoters to YPRCtau3 | 92% | 59 | 63% | 59 |
| #08 singleplex | crt cassettes with medium strength promoters to YPRCtau3 | 93% | 70 | 53% | 55 |
| #09 singleplex | crt cassettes with high strength promoters to YPRCtau3 | 75% | 24 | 39% | 24 |
| #10 singleplex | Control transformation, transformed pRN1120 (as circular vector), no guide RNA added | 0% | 37 | 0% | 33 |
| #11 singleplex | Control transformation, transformed | 0% | 0 | 0% | 0 |

TABLE 13-continued

Percentage colored cells obtained in the different singleplex transformation experiments plated on YPD (2%) + G418 + NatMX agar plates (double selection) to allow selection on both the CAS9 and guide RNA containing vectors or plated on YPD (2%) + NatMX agar plates (single selection) to allow selection on only the guide RNA containing vector.

| Experiment | Description experiment | % Colored cells (double selection) | Number of transformants obtained (double selection) | % Colored cells (single selection) | Number of transformants obtained (single selection) |
|---|---|---|---|---|---|
|  | pRN1120 (as linearized vector), no guide RNA added |  |  |  |  |

The results in Table 13 demonstrated that three carotenogenic genes can be functionally introduced into the genomic DNA of a host by the method described above and as depicted in FIG. 23 and FIG. 24. Independently of the promoters used (low, medium or high strength promoters) or the used integration site (INT1, INT59 or YPRCtau3), colored transformants were obtained indicating the transformants had integrated the donor DNA sequences in the genomic DNA. A number of these transformants were checked for the presence of donor DNA cassettes by PCR using a method known by a person skilled in the art. Integration of the donor DNA cassettes at the desired locus and correct assembly of the donor DNA cassettes as depicted in FIG. 23 was confirmed (data not shown). Omission of the guide RNA expression cassette in the transformation mixture resulted in transformants that were all white, thus reflecting non-engineered transformants (#10 singleplex transformation). A number of these transformants were checked for the absence of carotenogenic genes by PCR using a method known by a person skilled in the art. Absence of donor DNA cassettes was confirmed (data not shown).

After plating out the transformation mixtures, maintaining a double selection on both the presence of the single copy vector with a KanMX marker containing the CAS9 expression cassette and the multi copy vector with a NatMX marker containing the guide RNA expression cassette, resulted in a higher number of colored, thus engineered colonies compared to selecting only for the vector containing the guide RNA expression cassette (Table 13). It is thus advantageous to maintain the presence of both vectors containing CAS9 and the guide RNA after plating out the transformation mixtures in order to increase the number of colored, thus successfully engineered, transformants. As compared to the method for singleplex genome engineering described by Horwitz et al. 2015, the method we have used in this example offers a clear advantage: In the singleplex approach explained in this example we reached genome engineering efficiencies up to 93% colored, thus successfully engineered, transformants (Table 13), whereas Horwitz et al. 2015 only reported genome engineering efficiencies of maximally 65% for deletion of one gene.

The results demonstrated that in all singleplex experiments in which low (#01, #04, #07) and medium (#02, #05, #08) strength promoters were used, a higher number of transformants were obtained and also higher genome editing efficiencies (% colored cells) were reached, compared to singleplex experiments in which high strength promoters were used (#03, #06, #09). It is expected that a higher strength promoter resulted in higher expression of the crtE, crtYB and crtI proteins and thus higher carotenoid production levels, which is indeed confirmed later in this example (see Table 15). The lower number of transformants and the lower percentage of colored transformants when using high strength promoters might be explained by toxicity of the carotenoids produced, as a specific drug resistance response has been observed previously for S. cerevisiae cells producing higher levels of carotenoid compared to S. cerevisiae cells producing lower levels of carotenoids (Verwaal et al., 2010).

No transformants were obtained in experiment #11 singleplex transformation. These results demonstrated that only when a functional (circular) pRN1120 vector was formed, nourseothricin-resistant transformants were obtained.

Carotenoid Production

To demonstrate that the colored transformants were producing carotenoids, transformants were inoculated in a shake flask in Verduyn medium comprising 5 milliliter 2% glucose (Verduyn et al., 1992) and cultivated for 48 hrs at 30 degrees Celsius while stirred at 250 rpm. Subsequently, 1 ml of the culture was transferred to a shake flask containing Verduyn medium comprising 50 milliliter 2% glucose (Verduyn et al., 1992) and cultivated for 72 hrs at 30 degrees Celsius while stirred at 250 rpm.

Carotenoids were extracted using a PRECELLYS® 24 high-throughput tissue homogenizer. Briefly, 1 ml with an equivalent of 20 OD600 units of culture was pelleted in a PRECELLYS tube and the pellet was extracted with 1 ml tetrahydrofuran (containing 0.01% butylhydroxytoluene (BHT)) by homogenization for 3×15 sec at 6500 rpm. Following centrifugation for 5 min at 4° C., 800 microliters were then transferred to a glass vial. Extracts were dried down and resuspended in 80 microliters dichloromethane followed by 720 microliters of a 50:50 (v/v) mixture of heptane and ethyl acetate (containing 0.01% BHT). HPLC analysis of carotenoids was performed essentially as described (U.S. Pat. No. 7,851,199B2).

In total, 87 independent colored transformants expressing the three carotenoid genes from a low, medium or high strength promoter, integrated at the INT1, INT59 or the YPRCtau3 locus, were analyzed for carotenoid production. Production of the carotenoids phytoene, lycopene and beta-carotene were measured (Table 14). As positive controls, strain CAR-001 (the integrative YB/I/E transformant as constructed by Verwaal et al., 2007, and also known as strain Orange02 (Verwaal et al., 2010)), was inoculated 8 times and analyzed for carotenoid production. As negative control, strain CEN.PK 113-7D was inoculated 8 times and analyzed for carotenoid production. Introduction of carotenogenic crtE, crtYB and crtI expression cassettes results in production of, amongst others, the carotenoids phytoene, lycopene and beta-carotene in *S. cerevisiae* (Verwaal et al., 2007; Verwaal et al., 2010; Mitchel et al., 2015). Phytoene is colorless (Meléndez-Martínez et al., 2015), lycopene is red (Shi and Le Maguer, 2000) and beta-carotene is yellow to orange (Eldahshan and Singab, 2013).

The individual data per transformant is depicted in Table 14. The average and standard deviation of phytoene, lycopene, beta-carotene and total carotenoids levels of similar groups of transformants (carotenogenic genes expressed from low, medium or high strength (strong) promoters are depicted in Table 15. On average, transformants expressing crtE, crtYB and crtI using low strength promoters accumulate low levels of phytoene, even lower levels of beta-carotene, no or below quantification levels of lycopene and these transformants produced on average 0.12 µg/OD with a standard deviation of 0.07 µg/OD total carotenoids. On average, transformants expressing crtE, crtYB and crtI using medium strength promoters accumulate low levels of phytoene, similar low levels of beta-carotene, no or below quantification levels of lycopene and these transformants produced on average 0.23±0.08 µg/OD total carotenoids.

Thus, the use of medium strength promoters increases the flux through the introduced carotenogenic pathway, resulting in higher beta-carotene and total carotenoids production levels. On average, transformants expressing crtE, crtYB and crtI using high strength (strong) promoters accumulate the highest levels of phytoene of all transformants, the highest levels of beta-carotene were measured, which were even higher than phytoene. Thus, the use of high strength promoters for expression of the carotenogenic genes crtE, crtYB and crtI results in the highest levels of accumulation of beta-carotene, the final product of the introduced pathway. The average total carotenoid produced in the "strong promoter" transformants in which below quantification levels of lycopene were measured was 1.00±0.08 µg/OD. The average total carotenoid produced in the "strong promoter" transformants in which lycopene could be quantified was 4.09±0.92 µg/OD. On average, the control strain CAR-001 produced the lowest levels of phytoene, lycopene, beta-carotene and total carotenoids. No phytoene, lycopene and beta-carotene was accumulated in the control strain CEN.PK-113-7D.

TABLE 14

Production of different carotenoids, phytoene, lycopene and beta-carotene, in different strains grown in shake flask. The strains include the positive control CAR-001 and the negative control CEN.PK113-7D. For some transformants, white colored (non-engineered) transformants were included in the analysis.

| Strain | Promotor strength carotenoid genes (crtE-crtYB-crtI) | Integration site | Colored transformant | Phytoene [µg/OD] | Lycopene [µg/OD] | Beta-carotene [µg/OD] | Total carotenoids [µg/OD] |
|---|---|---|---|---|---|---|---|
| 1  | L-L-L | INT1  | Yes | 0.17 | <    | <    | 0.17 |
| 2  | L-L-L | INT1  | Yes | 0.17 | <    | <    | 0.17 |
| 3  | L-L-L | INT1  | Yes | 0.19 | <    | 0.02 | 0.21 |
| 4  | L-L-L | INT1  | Yes | 0.16 | <    | <    | 0.16 |
| 5  | L-L-L | INT1  | Yes | 0.19 | <    | 0.02 | 0.21 |
| 6  | L-L-L | INT1  | Yes | 0.18 | <    | 0.01 | 0.20 |
| 7  | L-L-L | INT1  | No  | n.a. | n.a. | n.a. | 0.00 |
| 8  | L-L-L | INT1  | No  | n.a. | n.a. | n.a. | 0.00 |
| 9  | M-M-M | INT1  | Yes | 0.15 | <    | 0.15 | 0.30 |
| 10 | M-M-M | INT1  | Yes | 0.15 | <    | 0.16 | 0.31 |
| 11 | M-M-M | INT1  | Yes | 0.15 | <    | 0.18 | 0.33 |
| 12 | M-M-M | INT1  | Yes | 0.17 | <    | 0.20 | 0.37 |
| 13 | M-M-M | INT1  | Yes | 0.13 | <    | 0.10 | 0.23 |
| 14 | M-M-M | INT1  | Yes | 0.15 | <    | 0.15 | 0.29 |
| 15 | M-M-M | INT1  | No  | n.a. | n.a. | n.a. | 0.00 |
| 16 | M-M-M | INT1  | No  | n.a. | n.a. | n.a. | 0.00 |
| 17 | S-S-S | INT1  | Yes | 0.56 | 3.05 | 1.61 | 5.21 |
| 18 | S-S-S | INT1  | Yes | 0.56 | 2.92 | 1.71 | 5.19 |
| 19 | S-S-S | INT1  | Yes | 0.23 | <    | 0.53 | 0.76 |
| 20 | S-S-S | INT1  | Yes | 0.39 | <    | 0.96 | 1.35 |
| 21 | S-S-S | INT1  | Yes | 0.38 | <    | 0.93 | 1.31 |
| 22 | S-S-S | INT1  | Yes | 0.16 | <    | 0.27 | 0.43 |
| 23 | S-S-S | INT1  | Yes | 0.25 | <    | 0.44 | 0.68 |
| 24 | S-S-S | INT1  | Yes | 0.50 | 2.17 | 0.97 | 3.63 |
| 25 | S-S-S | INT1  | Yes | 0.50 | 2.56 | 1.04 | 4.10 |
| 26 | S-S-S | INT1  | No  | n.a. | n.a. | n.a. | 0.00 |
| 27 | S-S-S | INT1  | No  | n.a. | n.a. | n.a. | 0.00 |
| 28 | L-L-L | INT59 | Yes | <    | <    | 0.02 | 0.02 |
| 29 | L-L-L | INT59 | Yes | <    | n.a. | 0.02 | 0.02 |
| 30 | L-L-L | INT59 | Yes | <    | <    | 0.03 | 0.03 |
| 31 | L-L-L | INT59 | Yes | <    | <    | 0.03 | 0.03 |
| 32 | L-L-L | INT59 | Yes | <    | <    | 0.03 | 0.03 |
| 33 | L-L-L | INT59 | No  | n.a. | n.a. | n.a. | 0.00 |
| 34 | L-L-L | INT59 | No  | 0.15 | n.a. | n.a. | 0.15 |
| 35 | M-M-M | INT59 | Yes | 0.11 | <    | 0.06 | 0.16 |
| 36 | M-M-M | INT59 | Yes | 0.12 | <    | 0.10 | 0.23 |
| 37 | M-M-M | INT59 | Yes | 0.12 | <    | 0.09 | 0.21 |
| 38 | M-M-M | INT59 | Yes | 0.13 | <    | 0.10 | 0.24 |
| 39 | M-M-M | INT59 | Yes | 0.10 | <    | 0.04 | 0.14 |
| 40 | M-M-M | INT59 | Yes | 0.09 | <    | 0.06 | 0.15 |
| 41 | M-M-M | INT59 | No  | n.a. | n.a. | n.a. | 0.00 |
| 42 | M-M-M | INT59 | No  | n.a. | n.a. | n.a. | 0.00 |

TABLE 14-continued

Production of different carotenoids, phytoene, lycopene and beta-carotene, in different strains grown in shake flask. The strains include the positive control CAR-001 and the negative control CEN.PK113-7D. For some transformants, white colored (non-engineered) transformants were included in the analysis.

| Strain | Promotor strength carotenoid genes (crtE-crtYB-crtI) | Integration site | Colored transformant | Phytoene [μg/OD] | Lycopene [μg/OD] | Beta-carotene [μg/OD] | Total carotenoids [μg/OD] |
|---|---|---|---|---|---|---|---|
| 43 | M-M-M | INT59 | No | n.a. | n.a. | n.a. | 0.00 |
| 44 | M-M-M | INT59 | No | 0.34 | n.a. | n.a. | 0.34 |
| 45 | S-S-S | INT59 | Yes | 0.26 | < | 0.59 | 0.85 |
| 46 | S-S-S | INT59 | Yes | 0.32 | < | 0.62 | 0.93 |
| 47 | S-S-S | INT59 | Yes | 0.32 | < | 0.75 | 1.07 |
| 48 | S-S-S | INT59 | Yes | 0.28 | < | 0.71 | 0.98 |
| 49 | S-S-S | INT59 | Yes | 0.40 | < | 1.00 | 1.39 |
| 50 | S-S-S | INT59 | Yes | 0.35 | < | 0.86 | 1.21 |
| 51 | S-S-S | INT59 | Yes | 0.23 | < | 0.52 | 0.75 |
| 52 | S-S-S | INT59 | Yes | 0.19 | < | 0.43 | 0.62 |
| 53 | S-S-S | INT59 | Yes | 0.15 | < | 0.55 | 0.71 |
| 54 | S-S-S | INT59 | Yes | 0.30 | 2.17 | 0.80 | 3.27 |
| 55 | S-S-S | INT59 | Yes | 0.27 | 2.21 | 0.69 | 3.17 |
| 56 | S-S-S | INT59 | No | n.a. | n.a. | n.a. | 0.00 |
| 57 | S-S-S | INT59 | No | n.a. | n.a. | n.a. | 0.00 |
| 58 | L-L-L | YPRCtau3 | Yes | 0.18 | < | < | 0.18 |
| 59 | L-L-L | YPRCtau3 | Yes | 0.18 | < | < | 0.18 |
| 60 | L-L-L | YPRCtau3 | Yes | 0.08 | n.a. | n.a. | 0.08 |
| 61 | L-L-L | YPRCtau3 | Yes | 0.16 | n.a. | < | 0.16 |
| 62 | L-L-L | YPRCtau3 | Yes | 0.12 | n.a. | < | 0.12 |
| 63 | L-L-L | YPRCtau3 | Yes | 0.12 | n.a. | < | 0.12 |
| 64 | L-L-L | YPRCtau3 | No | n.a. | n.a. | n.a. | 0.00 |
| 65 | L-L-L | YPRCtau3 | No | n.a. | n.a. | n.a. | 0.00 |
| 66 | M-M-M | YPRCtau3 | Yes | 0.13 | n.a. | 0.10 | 0.23 |
| 67 | M-M-M | YPRCtau3 | Yes | 0.11 | n.a. | 0.08 | 0.19 |
| 68 | M-M-M | YPRCtau3 | Yes | 0.10 | n.a. | 0.06 | 0.16 |
| 69 | M-M-M | YPRCtau3 | Yes | 0.09 | n.a. | 0.05 | 0.14 |
| 70 | M-M-M | YPRCtau3 | Yes | 0.13 | n.a. | 0.09 | 0.22 |
| 71 | M-M-M | YPRCtau3 | Yes | < | n.a. | 0.04 | 0.04 |
| 72 | M-M-M | YPRCtau3 | No | n.a. | n.a. | n.a. | 0.00 |
| 73 | M-M-M | YPRCtau3 | No | n.a. | n.a. | n.a. | 0.00 |
| 74 | S-S-S | YPRCtau3 | Yes | n.a. | < | 0.06 | 0.06 |
| 75 | S-S-S | YPRCtau3 | Yes | 0.35 | < | 0.81 | 1.16 |
| 76 | S-S-S | YPRCtau3 | Yes | 0.48 | < | 0.87 | 1.36 |
| 77 | S-S-S | YPRCtau3 | Yes | 0.52 | < | 1.06 | 1.58 |
| 78 | S-S-S | YPRCtau3 | Yes | 0.43 | < | 0.89 | 1.32 |
| 79 | S-S-S | YPRCtau3 | Yes | 0.25 | < | 0.65 | 0.90 |
| 80 | S-S-S | YPRCtau3 | Yes | 0.17 | < | 0.56 | 0.73 |
| 81 | S-S-S | YPRCtau3 | Yes | 0.58 | < | 1.30 | 1.88 |
| 82 | S-S-S | YPRCtau3 | Yes | 0.38 | < | 0.88 | 1.25 |
| 83 | S-S-S | YPRCtau3 | Yes | 0.25 | n.a. | 0.42 | 0.67 |
| 84 | S-S-S | YPRCtau3 | Yes | 0.35 | < | 0.66 | 1.00 |
| 85 | S-S-S | YPRCtau3 | Yes | 0.30 | < | 0.71 | 1.02 |
| 86 | S-S-S | YPRCtau3 | No | n.a. | n.a. | n.a. | 0.00 |
| 87 | S-S-S | YPRCtau3 | No | n.a. | n.a. | n.a. | 0.00 |
| 88 | CAR-001 | | Yes | 0.06 | < | 0.05 | 0.11 |
| 89 | CAR-001 | | Yes | < | < | 0.02 | 0.02 |
| 90 | CAR-001 | | Yes | < | < | 0.04 | 0.04 |
| 91 | CAR-001 | | Yes | < | < | 0.02 | 0.02 |
| 92 | CAR-001 | | Yes | < | n.a. | 0.03 | 0.03 |
| 93 | CAR-001 | | Yes | 0.08 | < | 0.10 | 0.18 |
| 94 | CAR-001 | | Yes | 0.07 | < | 0.06 | 0.13 |
| 95 | CAR-001 | | Yes | 0.09 | < | 0.17 | 0.26 |
| 96 | CEN.PK.113-7D | | No | n.a. | n.a. | n.a. | 0.00 |
| 97 | CEN.PK.113-7D | | No | n.a. | n.a. | n.a. | 0.00 |
| 98 | CEN.PK.113-7D | | No | n.a. | n.a. | n.a. | 0.00 |
| 99 | CEN.PK.113-7D | | No | n.a. | n.a. | n.a. | 0.00 |
| 100 | CEN.PK.113-7D | | No | n.a. | n.a. | n.a. | 0.00 |
| 101 | CEN.PK.113-7D | | No | n.a. | n.a. | n.a. | 0.00 |
| 102 | CEN.PK.113-7D | | No | n.a. | n.a. | n.a. | 0.00 |

TABLE 14-continued

Production of different carotenoids, phytoene, lycopene and beta-carotene, in different strains grown in shake flask. The strains include the positive control CAR-001 and the negative control CEN.PK113-7D. For some transformants, white colored (non-engineered) transformants were included in the analysis.

| Strain | Promotor strength carotenoid genes (crtE-crtYB-crtI) | Integration site | Colored transformant | Phytoene [μg/OD] | Lycopene [μg/OD] | Beta-carotene [μg/OD] | Total carotenoids [μg/OD] |
|---|---|---|---|---|---|---|---|
| 103 | CEN.PK.113-7D | | No | n.a. | n.a. | n.a. | 0.00 |

< denotes a carotenoid peak was detected but below level of quantification, i.e. the peak could not be quantified.
n.a. denotes the carotenoid peak was not detected.
Carotenoid levels are calculated in microgram per OD600.

TABLE 15

Average and standard deviation of phytoene, lycopene, beta-carotene and total carotenoids levels of similar groups of transformants (carotenogenic genes expressed from low, medium or high strength (strong) promoters. The effect of the integration site was not included in the calculations. The average and standard deviation was calculated from the data depicted in Table 14.

| Promotor strength carotenoid genes (crtE-crtYB-crtI) | Phytoene [μg/OD] | Lycopene [μg/OD] | Beta-carotene [μg/OD] | Total carotenoids [μg/OD] | |
|---|---|---|---|---|---|
| L-L-L | 0.16 ± 0.03 | 0 | 0.02 ± 0.01 | 0.12 ± 0.07 | |
| M-M-M | 0.14 ± 0.06 | 0 | 0.10 ± 0.05 | 0.23 ± 0.08 | |
| S-S-S | 0.34 ± 0.12 | 2.51 ± 0.40* | 0.78 ± 0.34 | 1.00 ± 0.39 (excluding lycopene) | 4.09 ± 0.92 (including lycopene) |
| CAR-001 | 0.08 ± 0.01 | 0 | 0.06 ± 0.06 | 0.10 ± 0.09 | |
| CEN.PK113-7D | 0 | 0 | 0 | 0 | |

*denotes that the average lycopene accumulation (and standard deviation) was calculated from only the transformants in which a lycopene signal was measured (below quantification levels of lycopene were omitted from the calculations). Carotenoid levels are calculated in microgram per OD600.

These results demonstrate that using the singleplex approach as set out in this example and graphically depicted in FIG. 23 and FIG. 24, yeast strains producing different amounts of carotenoids can be constructed. As expected, low strength promoters gave the lowest production levels of total carotenoids, medium strength promoters gave higher production levels of total carotenoids and strong promoters gave the highest levels of total carotenoids. This example clearly shows that the method of the invention allows efficient construction of strains containing multiple genes (pathways) in in a single locus. The method of the invention may advantageously be used as well to optimize expression levels of pathways and/or fine-tune pathways in a single locus in genomic DNA of a host strain to further optimize productivity of a strain for a product of interest.

Example 10: Engineering of Three Genomic Target Sites (Multiplex) Using 50 Bp Flank Sequences Present in Donor DNA In this multiplex engineering example the simultaneous integration of three functional carotenoid gene expression cassettes into three different loci of genomic DNA of a host organism using CRISPR/CAS9 is demonstrated. The integration of said three functional carotenoid gene expression cassettes, being a combination of crtE, crtYB and crtI, enables carotenoid production by the host organism (as illustrated in FIG. 25 and FIG. 26).

In this example, two different multiplex genome engineering approaches were applied. In approach 1, three different guide RNA expression cassettes that each contain at their 5' and 3' ends a DNA sequence homologous to a linearized multicopy yeast expression vector were transformed together with the required donor DNA sequences in order to allow multiplex genome engineering. The three gRNA expression cassettes comprise three different genomic targets, thereby targeting CAS9 to three different loci in the host genome to make a double stranded break at each locus. This method is illustrated as approach 1 in FIG. 26.

In approach 2, a different approach concerning the three different guide RNA expression cassettes was evaluated. The first guide RNA expression cassette contains a DNA sequence at its 5' end that is homologous to the linearized multicopy yeast expression vector and contains a DNA sequence at its 3' end that is homologous to a connector sequence present at the 5' end of the second guide RNA expression cassette. The second guide RNA expression cassette contains a DNA sequence at its 5' end that is homologous to a connector sequence present at the 3' end of the first guide RNA expression cassette and contains a DNA sequence at its 3' end that is homologous to a connector sequence present at the 5' end of the third guide RNA expression cassette. The third guide RNA expression cassette contains a DNA sequence at its 5' end that is homologous to a connector sequence present at the 3' end of the second guide RNA expression cassette and contains a DNA sequence at its 3' end that is homologous to the linearized multicopy yeast expression vector. The three gRNA expression cassettes comprise three different genomic targets, allowing the CAS9 protein to target to different genomic DNA loci to make a double stranded break. This method, which is illustrated as approach 2 in FIG. 26, enabled in vivo assembly of the three guide RNA expression cassettes into a multicopy vector. The resulting vector will contain three guide RNA expression cassettes and thus expresses three guide RNA expression cassettes from one vector, thereby targeting CAS9 to three different loci in the host genome to make a double stranded break at each locus. The guide RNA expression cassettes were transformed together with the required donor DNA sequences in order to allow multiplex genome engineering.

Vectors

Vectors pCSN061 (SEQ ID NO: 135) and pRN1120 (SEQ ID NO: 136) were constructed as described in Example 9.

Donor DNA

PCR fragments were used as donor DNA in the multiplex genome engineering experiments. The donor DNA sequences were derived from various sources, as indicated in Table 16. Donor DNA sequences in the multiplex experiment are expression cassettes (i.e. carotenoid gene expression cassettes) that can be integrated into the desired locus within the genomic DNA.

TABLE 16

Overview of different donor DNA sequences used in the multiplex experiment. Under description, the following elements are indicated: The promoter including the relative expected expression strengths (Low p = low strength promoter, Med p = medium strength promoter, Strong p = high strength promoter). The ORF name, crtE, crtYB or crtI, and the terminator sequence. This table includes the SEQ ID NO's of the primers used to obtain the donor DNA sequences by amplification by PCR. INT1: INT1 integration site. INT2: INT59 integration site. INT3: YPRCtau3 integration site.

| Name | Promoter strength | Description | Targeting to | Template for PCR | Forward primer | Reverse primer |
| --- | --- | --- | --- | --- | --- | --- |
| SEQ ID NO: 181 | L | Homology to INT1 - Low p (KlTDH2p) - crtE - ScTDH3t - Homology to INT1 | INT1 locus | SEQ ID NO: 137 | SEQ ID NO: 190 | SEQ ID NO: 191 |
| SEQ ID NO: 182 | M | Homology to INT1 - Med p (KlPGK1p) - crtE - ScTDH3t - Homology to INT1 | INT1 locus | SEQ ID NO: 138 | SEQ ID NO: 192 | SEQ ID NO: 191 |
| SEQ ID NO: 183 | S | Homology to INT1 - Strong p (ScFBA1p) - crtE - ScTDH3t - Homology to INT1 | INT1 locus | SEQ ID NO: 139 | SEQ ID NO: 193 | SEQ ID NO: 191 |
| SEQ ID NO: 184 | L | Homology to INT2 - Low p (KlYDR1p) - crtYB - ScPDC1t - Homology to INT2 | INT2 locus | SEQ ID NO: 140 | SEQ ID NO: 194 | SEQ ID NO: 195 |
| SEQ ID NO: 185 | M | Homology to INT2 - Med p (KlTEF2p) - crtYB - ScPDC1t - Homology to INT2 | INT2 locus | SED ID NO: 141 | SEQ ID NO: 196 | SEQ ID NO: 195 |
| SEQ ID NO: 186 | S | Homology to INT2 - Strong p (ScTEF1p) - crtYB - ScPDC1t - Homology to INT2 | INT2 locus | SEQ ID NO: 142 | SEQ ID NO: 197 | SEQ ID NO: 195 |
| SEQ ID NO: 187 | L | Homology to INT3 - Low p (ScPRE3p) - crtI - ScTAL1t - Homology to INT3 | INT3 locus | SEQ ID NO: 143 | SED ID NO: 198 | SEQ ID NO: 199 |
| SEQ ID NO: 188 | M | Homology to INT3 - Med p (ScACT1p) - crtI - ScTAL1t - | INT3 locus | SEQ ID NO: 144 | SED ID NO: 200 | SEQ ID NO: 199 |

TABLE 16-continued

Overview of different donor DNA sequences used in the multiplex experiment. Under description, the following elements are indicated: The promoter including the relative expected expression strengths (Low p = low strength promoter, Med p = medium strength promoter, Strong p = high strength promoter). The ORF name, crtE, crtYB or crtI, and the terminator sequence. This table includes the SEQ ID NO's of the primers used to obtain the donor DNA sequences by amplification by PCR. INT1: INT1 integration site. INT2: INT59 integration site. INT3: YPRCtau3 integration site.

| Name | Promoter strength | Description | Targeting to | Template for PCR | Forward primer | Reverse primer |
|---|---|---|---|---|---|---|
| SEQ ID NO: 189 | S | Homology to INT3 Homology to INT3 - Strong p (KlENO1p) - crtI - ScTAL1t - Homology to INT3 | INT3 locus | SEQ ID NO: 145 | SED ID NO: 201 | SEQ ID NO: 199 |

The carotenoid gene expression cassettes, of which the sequences are set out in SEQ ID NO: 181 to SEQ ID NO: 189, were obtained by PCR and were used as donor DNA expression cassettes that were integrated into genomic DNA using the approach described in this example. A carotenoid gene expression cassette was composed of the following elements: at the 5' and 3' positions of the DNA sequence, approximately 50 basepair (bp) flank sequences were present that contain homology with the desired genomic integration site (INT1, INT2 or INT3). In this example INT1 is the INT1 integration site, INT2 is the INT59 integration site, INT3 is the YPRCtau3 integration site. The presence of flank sequences allowed introduced of carotenoid expression cassettes into the genomic DNA. As a result, different donor DNA fragments assembled into the genomic DNA at different desired location, as is depicted in FIG. 25. A promoter sequence, which can be homologous (i.e. from *S. cerevisiae*) or heterologous (e.g. from *Kluyveromyces lactis*) and a terminator sequences derived from *S. cerevisiae*, were used to control the expression of the carotenogenic genes crtE, crtYB or crtI. As described in Table 16 the promoters are expected to have different expression strengths, resulting in low, medium or high expression levels of crtE, crtYB or crtI. As shown in Example 9, low strength promoters gave the lowest production levels of total carotenoids, medium strength promoters gave higher production levels of total carotenoids and strong promoters gave the highest levels of total carotenoids. The crtE, crtYB and crtI nucleotide sequences were codon pair optimized for expression in *S. cerevisiae* as described in WO2008/000632.

PCR fragments of the donor DNA expression cassette sequences were generated by PCR using Phusion DNA polymerase (New England Biolabs, USA) according to manufacturer's instructions. In case of the expression cassettes of the carotenogenic genes, the synthetic DNA provided by DNA2.0 was used as a template in the PCR reaction, using the specific forward and reverse primer combinations depicted in Table 16. For example, in order to obtain the PCR fragment set out in SEQ ID NO: 181, the synthetic DNA construct SEQ ID NO: 137 provided by DNA2.0 was used as a template, using primer sequences set out in SEQ ID NO: 190 and SEQ ID NO: 191. In total, nine different donor DNA sequences containing the carotenoid gene expression cassettes were generated by PCR, as set out in SEQ ID NO: 181; 182; 183; 184; 185; 186; 187; 188 and 189. The expression cassettes (PCR fragments) containing a crtE ORF could be targeted to the INT1 locus, the expression cassettes (PCR fragments) containing a crtYB ORF could be targeted to the INT2 locus, the expression cassettes (PCR fragments) containing a crtI ORF could be targeted to the INT3 locus.

All donor DNA PCR fragments were purified using the NucleoSpin Gel and PCR Clean-up kit (Machery-Nagel, distributed by Bioké, Leiden, the Netherlands) according to manufacturer's instructions.

Guide RNA Expression Cassettes and Genomic Target Sequences

Guide RNA expression cassettes were ordered as synthetic DNA cassettes (gBlocks) at Integrated DNA Technologies, Leuven, Belgium (for an overview see Table 17).

For multiplex approach 1, the synthetic guide RNA expression cassettes, of which the sequences are set out SEQ ID NO: 173, 174 and 175, consisted of the SNR52p RNA polymerase III promoter, a genomic target sequence (SEQ ID NO: 176; 177; 178), the gRNA structural component and the SUP4 3' flanking region as described in DiCarlo et al., 2013. The guide RNA expression gBlock contained at their 5' end 78 basepairs homology and at their 3' end 87 bp homology with vector pRN1120 (after restriction of the vector with EcoRI and XhoI). The presence of homologous DNA sequences at the 5' and 3' end of the guide RNA cassettes will promote reconstitution of a circular vector in vivo by homologous recombination (gap repair) (Orr-Weaver et al., 1983).

For multiplex approach 2, the synthetic guide RNA expression cassettes, of which the sequences are set out SEQ ID NO: 202, 203 and 204, consisted of the SNR52p RNA polymerase III promoter, a genomic target sequence (SEQ ID NO: 176; 177; 178), the gRNA structural component and the SUP4 3' flanking region as described in DiCarlo et al., 2013. The first guide RNA expression cassette (SEQ ID NO: 202) contains a 78 bp DNA sequence at its 5' end that is homologous to the linearized multicopy yeast expression vector pRN1120 and contains a 50 bp con2A connector DNA sequence at its 3' end that is homologous to a 50 bp con2A connector DNA sequence present at the 5' end of the second guide RNA expression cassette (SEQ ID NO: 203). The second guide RNA expression cassette (SEQ ID NO: 203) contains a 50 bp con2A connector DNA sequence at its 5' end that is homologous to a 50 bp con2A connector sequence present at the 3' end of the first guide RNA expression cassette (SEQ ID NO: 202) and contains a 50 bp con2B connector DNA sequence at its 3' end that is homologous to a 50 bp con2B connector DNA sequence present at the 5' end of the third guide RNA expression cassette (SEQ ID NO: 204). The third guide RNA expression cassette (SEQ ID NO: 204) contains a 50 bp con2B connector DNA sequence at its 5' end that is homologous to a 50 bp con2B connector DNA sequence present at the 3' end of the second guide RNA expression cassette (SEQ ID NO: 203) and contains a 87 bp DNA sequence at its 3' end that is homologous to the linearized multicopy yeast expression vector pRN1120. This method, which is illustrated in FIG. 26, enabled in vivo assembly of the guide RNA expression cassettes into the multicopy pRN1120 vector that contains, in this case, three guide RNA expression cassettes, resulting in a circular vector (Orr-Weaver et al., 1983).

The gBlocks were individually ligated into the pCR-BluntII-TOPO vector (Zero Blunt TOPO PCR Cloning Kit, Life Technologies, Grand Island, N.Y., USA) according to manufacturer's instructions. Using the TOPO vector containing the gBlock as template, Phusion DNA polymerase (New England Biolabs, USA), and the different primer combinations as shown in Table 17, guide RNA expression cassette PCR fragments for approach 1 (INT1, SEQ ID NO: 176; INT2, SEQ ID NO: 177; INT3 and SEQ ID NO: 178) and for approach 2 (INT1, SEQ ID NO: 202; INT2, SEQ ID NO: 203 and INT3, SEQ ID NO: 204) were generated. All guide RNA expression cassette PCR fragments were purified using the NuceloSpin Gel and PCR Clean-up kit (Machery-Nagel, distributed by Bioké, Leiden, the Netherlands) according to manufacturer's instructions.

TABLE 17

Overview of genomic target and guide RNA sequences used in the approach 1 and approach 2 multiplex experiments. The guide RNA expression cassettes were used as a template for PCR using the primers indicated in this table in order to obtain guide RNA expression PCR fragments used in the transformation experiments.

| Target | Genomic target SEQ ID NO: | Guide RNA expression cassette | Primers used to amplify guide RNA cassette | Multiplex approach |
|---|---|---|---|---|
| INT1 locus | SEQ ID NO: 176 | SEQ ID NO: 173 | SEQ ID NO: 179 SEQ ID NO: 180 | 1 |
| INT2 locus | SEQ ID NO: 177 | SEQ ID NO: 174 | SEQ ID NO: 179 SEQ ID NO: 180 | 1 |
| INT3 locus | SEQ ID NO: 178 | SEQ ID NO: 175 | SEQ ID NO: 179 SEQ ID NO: 180 | 1 |
| INT1 locus | SEQ ID NO: 176 | SEQ ID NO: 202 | SEQ ID NO: 179 SEQ ID NO: 205 | 2 |
| INT2 locus | SEQ ID NO: 177 | SEQ ID NO: 203 | SEQ ID NO: 206 SEQ ID NO: 207 | 2 |
| INT3 locus | SEQ ID NO: 178 | SEQ ID NO: 204 | SEQ ID NO: 208 SEQ ID NO: 180 | 2 |

Integration Sites:

The INT1 integration site is located at the non-coding region between NTR1 (YOR071c) and GYP1 (YOR070c) located on chromosome XV. The INT2 or INT59 integration site is a non-coding region between SRP40 (YKR092C) and PTR2 (YKR093W) located on chromosome XI. The INT3 or YPRCtau3 integration site is a Ty4 long terminal repeat, located on chromosome XVI, and has been described by Bai Flagfeldt et al. (2009).

Transformation and Multiplex Engineering

The procedure for the multiplex engineering experiments for approach 1 and 2 is depicted in FIG. 25 and FIG. 26. Multiplex engineering in this example means the simultaneous integration of a set of three functional carotenoid gene expression cassettes, being a combination of crtE, crtYB and crtI, in order to enable carotenoid production, into three different loci of genomic DNA using CRISPR/CAS9.

Prior to transformation, DNA concentrations of the donor DNA's, guide RNA expression cassettes and vectors were measured using the NanoDrop (ND-1000 Spectrophotometer, Thermo Scientific).

Vector pSCN061 expressing CAS9 was first transformed to S. cerevisiae strain CEN.PK113-7D (MATa URA3 HIS3 LEU2 TRP1 MAL2-8 SUC2) using the LiAc/salmon sperm (SS) carrier DNA/PEG method (Gietz and Woods, 2002). In the transformation mixture 1 microgram (µg) of vector pCNS061 (FIG. 21) was used. The transformation mixture was plated on YPD-agar (10 grams per litre of yeast extract, 20 grams per litre of peptone, 20 grams per litre of dextrose, 20 grams per litre of agar) containing 200 (µg) G418 (Sigma Aldrich, Zwijndrecht, the Netherlands) per ml. After two to four days of growth at 30° C. colonies appeared on the transformation plate.

A yeast colony conferring resistance to G418 on the plate, now referred as strain CSNO01, was inoculated on YPD-G418 medium (10 grams per litre of yeast extract, 20 grams per litre of peptone, 20 grams per litre of dextrose, 200 µg G418 (Sigma Aldrich, Zwijndrecht, the Netherlands) per ml). Subsequently, strain CSNO01 was transformed with the following DNA fragments using the LiAc/SS carrier DNA/PEG method (Gietz and Woods, 2002):

For approach 1, ¹/₁₀ of the molar mass relative to a guide RNA PCR fragment of purified linearized vector pRN1120, 1 equivalent of a molar mass of each of the three guide RNA expression cassettes (PCR fragment) containing homology at their 5' and 3' end with vector pRN1120, three donor DNA cassettes (PCR fragments) being ⅕ of the molar mass relative to a guide RNA PCR fragment of the three carotenoid gene expression cassettes (donor DNA expression cassettes). Because of the presence of similar DNA sequences of approximately 50 bp homologous to the integration site, the donor DNA expression cassettes will integrate at the desired location into the genomic DNA as visualized in FIG. 25. Any of the three guide RNA expression cassettes, which contains 78 bp homology at the 5' and 87 bp homology at the 3' end with vector pRN1120, can assemble into the linearized vector pRN1120 to form a functional circular vector (FIG. 26) by in vivo homologous recombination (gap repair, Orr-Weaver et al., 1983), which allows selection of transformants on nourseothricin.

For approach 2, ¹/₁₀ of the molar mass relative to a guide RNA PCR fragment of purified linearized vector pRN1120, 1 equivalent of a molar mass of each of the three guide RNA expression cassettes (PCR fragment) containing different stretches of homology as described about under "Guide RNA expression cassettes and genomic target sequences", three donor DNA cassettes (PCR fragments) being ⅕ of the molar mass relative to a guide RNA PCR fragment of the three carotenoid gene expression cassettes (donor DNA expression cassettes). Because of the presence of similar DNA sequences of approximately 50 bp homologous to the integration site, the donor DNA expression cassettes will integrate at the desired location into the genomic DNA as visualized in FIG. 25. All three guide RNA expression cassettes will assemble into the linearized vector pRN1120 to form a functional circular vector (FIG. 26) by in vivo homologous recombination (gap repair, Orr-Weaver et al., 1983), which allows selection of transformants on nourseothricin.

As shown in Table 18, different transformation experiments were performed to determine the effect of introduction of different carotenoid gene expression cassettes at different genomic integration sites on the efficiency of multiplex CRISPR/CAS9 mediated genome engineering in *S. cerevisiae*. For example in multiplex experiment #01 (approach 1), strain CSN001 was transformed with ⅒ of the molar mass relative to a guide RNA PCR fragment of linearized pRN1120, 1 equivalent of a molar mass of each guide RNA (SEQ ID NO: 173, SEQ ID NO: 174 and SEQ ID NO: 175), and ⅕ of the molar mass relative to a guide RNA PCR fragment of donor DNA expression cassettes (SEQ ID NO: 181; 184 and 187). In this experiment, CAS9 was targeted to the INT1, INT2 and INT3 locus to create a double stranded break, the crtE expression cassette was targeted to the INT1 locus, the crtYB expression cassette was targeted to the INT2 locus and the crtI expression cassette was targeted to the INT3 locus. In this transformation all carotenoid expression cassettes contained low strength promoters. The double stranded breaks that were introduced by CAS9 were repaired by the transformed donor DNA PCR fragments (FIG. 25).

The transformation mixtures were plated on YPD-agar (10 grams per litre of yeast extract, 20 grams per litre of peptone, 20 grams per litre of dextrose, 20 grams per litre of agar) containing 200 μg nourseothricin (NatMX, Jena Bioscience, Germany) and 200 μg G418 (Sigma Aldrich, Zwijndrecht, the Netherlands) per ml. After two to four days of growth at 30° C., colonies appeared on the transformation plates.

TABLE 18

Overview of transformation experiments performed in the multiplex experiment. In a first transformation vector pCSN061 was transformed. In a second transformation vector pRN1120, restricted with EcoRI and XhoI, was transformed together with 3 donor DNA expression fragments and three guide RNA expression cassettes.

| Experiment | Description experiment | Vectors | guide RNAs | Donor DNA expression cassettes |
|---|---|---|---|---|
| #01 multiplex approach 1 | crt cassettes with low strength promoters to INT1, INT2 and INT3 | pSCN061 pRN1120 (restricted with EcoRI and XhoI) | SEQ ID NO: 173 SEQ ID NO: 174 SEQ ID NO: 175 | SEQ ID NO: 181 SEQ ID NO: 184 SEQ ID NO: 187 |
| #02 multiplex approach 1 | crt cassettes with medium strength promoters to INT1, INT2 and INT3 | pSCN061 pRN1120 (restricted with EcoRI and XhoI) | SEQ ID NO: 173 SEQ ID NO: 174 SEQ ID NO: 175 | SEQ ID NO: 182 SEQ ID NO: 185 SEQ ID NO: 188 |
| #03 multiplex approach 1 | crt cassettes with high strength promoters to INT1, INT2 and INT3 | pSCN061 pRN1120 (restricted with EcoRI and XhoI) | SEQ ID NO: 173 SEQ ID NO: 174 SEQ ID NO: 175 | SEQ ID NO: 183 SEQ ID NO: 186 SEQ ID NO: 189 |
| #04 multiplex approach 2 | crt cassettes with low strength promoters to INT1, INT2 and INT3 | pSCN061 pRN1120 (restricted with EcoRI and XhoI) | SEQ ID NO: 202 SEQ ID NO: 203 SEQ ID NO: 204 | SEQ ID NO: 181 SEQ ID NO: 184 SEQ ID NO: 187 |
| #05 multiplex approach 2 | crt cassettes with medium strength promoters to INT1, INT2 and INT3 | pSCN061 pRN1120 (restricted with EcoRI and XhoI) | SEQ ID NO: 202 SEQ ID NO: 203 SEQ ID NO: 204 | SEQ ID NO: 182 SEQ ID NO: 185 SEQ ID NO: 188 |
| #06 multiplex approach 2 | crt cassettes with high strength promoters to INT1, INT2 and INT3 | pSCN061 pRN1120 (restricted with EcoRI and XhoI) | SEQ ID NO: 202 SEQ ID NO: 203 SEQ ID NO: 204 | SEQ ID NO: 183 SEQ ID NO: 186 SEQ ID NO: 189 |

Multiplex Integration Efficiencies

Transformation of crtE, crtYB and crtI expression cassettes into different genomic loci (INT1, INT2 and INT3) resulted in colored transformants, by the integration of the three donor DNA expression cassettes into the desired loci in genomic DNA. After transformation, the total number of colonies on a transformation plate were counted. The transformants were colored and/or non-colored. In case of colored transformants, the crtE, crtYB and crtI expression cassettes were successfully integrated into the genomic DNA of the yeast cells. In case of non-colored transformants, crtE, crtYB and crtI expression cassettes were not successfully integrated into the genomic DNA of the yeast cells. The percentage of successfully engineered cells, i.e. transformants that have integrated the crtE, crtYB and crtI expression cassettes into genomic DNA, was calculated by dividing the number of colored transformants by the number of total transformants (Table 19).

The results in Table 19 demonstrated that three carotenogenic genes can be introduced into genomic DNA by the two different multiplex approaches described above and as depicted in FIG. 25 and FIG. 26. Independent of the promoters used (low, medium or high strength promoters) or the used integration site (INT1, INT59 (INT2) or YPRCtau3 (INT3)), colored transformants were obtained indicating the donor DNA sequences had integrated into the genomic DNA of the transformants. A number of these transformants were checked for the correct integration of crtE at the INT1 locus, the correct integration of crtYB at the INT2 locus and the correct integration of crtI at the INT3 locus by PCR using a method known by a person skilled in the art, which confirmed correct targeting occurred (data not shown).

TABLE 19

Percentage colored cells obtained in the different multiplex transformation experiments plated on YPD (2%) + G418 + NatMX agar plates (double selection) to allow selection on both the CAS9 and guide RNA containing vectors.

| Experiment | Description experiment | % Colored cells | Number of transformants obtained | Fold improvement compared to approach 1 |
|---|---|---|---|---|
| #01 multiplex approach 1 | crt cassettes with low strength promoters to INT1, INT2 and INT3 | 11% | 27 | n.a. |
| #02 multiplex approach 1 | crt cassettes with medium strength promoters to INT1, INT2 and INT3 | 4% | 45 | n.a. |
| #03 multiplex approach 1 | crt cassettes with high strength promoters to INT1, INT2 and INT3 | 5% | 60 | n.a. |
| #04 multiplex approach 2 | crt cassettes with low strength promoters to INT1, INT2 and INT3 | 83% | 53 | 7-fold |
| #05 multiplex approach 2 | crt cassettes with medium strength promoters to INT1, INT2 and INT3 | 69% | 13 | 16-fold |
| #06 multiplex approach 2 | crt cassettes with high strength promoters to INT1, INT2 and INT3 | 53% | 36 | 11-fold |

N.a. not applicable.

As compared to the method for multiplex genome engineering described by Horwitz et al. 2015 (in this example referred as approach 1), multiplex approach 2 described in this example offers a clear advantage: In vivo assembly of three guide RNA expression cassettes into a single (in vivo assembled) vector as used in approach 2 offers a 7 to 16 fold improvement compared to approach 1 in multiplex strain construction efficiency of strains that have integrated carotenoid expression cassettes at three different loci in the genomic DNA. In all of the transformations performed, multiplex approach 2 always shows a higher percentage of colored, thus engineered cells, as compared to multiplex approach 1.

This example clearly shows that the method of the invention allows efficient construction of strains containing multiple genes (pathways) in various loci using multiple guide RNA expression cassettes which are encoded on a single vector (obtained by in vivo recombination). The method of the invention may be used as well to screen for and optimize expression levels of pathways and/or fine-tune pathways in various loci in genomic DNA of a host strain to further optimize productivity of a strain for a product of interest.

Example 11: CRISPR/CAS9 Mediated Introduction of Three Expression Cassettes to Enable Carotenoid Production by Using a Flank_DNA-gRNA gBlock Approach In this example, crtE, crtI and crtYB expression cassettes were integrated into the genomic DNA of yeast strain CEN.PK113-7D using CRISPR/CAS9 in order to enable carotenoid production. A vector containing a CAS9 expression cassette was transformed first into the yeast cell. In a subsequent transformation, three crtE, crtI and crtYB donor DNA expression cassettes were transformed together with 100 base pair (bp) flank sequences that target the expression cassettes to the desired locations in vivo in genomic DNA. In the same transformation, a guide RNA expression cassette was included that contains 50 bp overlap at the 5' and 3' end with a linearized multicopy yeast expression vector, which will promote reconstitution of a circular vector in vivo by homologous recombination (gap repair) (Orr-Weaver et al., 1983). In this new approach, the so-called "flank_DNA-gRNA gBlock" consisting of a 100 bp left flank (homology to genomic DNA), a 100 bp right flank (homology to genomic DNA) and a guide RNA expression cassette are separated by one or two BsaI restriction sites as explained below. Prior to the transformation, the "flank_DNA-gRNA gBlock" was restricted by BsaI to liberate the left flank, the right flank and the guide RNA. The transformation and integration approach is explained below.

Vectors

Vectors pCSN061 (SEQ ID NO: 135) and pRN1120 (SEQ ID NO: 136) were constructed as described in Example 9. Vector pRN1120 can be equipped with a guide RNA cassettes as explained in this example. Prior to transformation, vector pRN1120 (FIG. 22) was restricted with the restriction enzymes EcoRI and XhoI. Next, the linearized vector was purified using the NucleoSpin Gel and PCR Clean-up kit (Machery-Nagel, distributed by Bioké, Leiden, the Netherlands) according to manufacturer's instructions.

Donor DNA

PCR fragments were used as donor DNA in the genome engineering experiment described in this example. Donor DNA sequences can be expression cassettes (i.e. carotenoid gene expression cassettes) or donor DNA flank sequences (i.e. sequences used to allow integration of the carotenoid gene expression cassettes into the desired so-called INT1 locus within the genomic DNA). The INT1 integration site is non-coding region between NTR1 (YOR071c) and GYP1 (YOR070c) located on chromosome XV of *S. cerevisiae*. The donor DNA sequences were derived from various sources, as indicated in Table 20.

TABLE 20

Overview of different donor DNA sequences (expression cassettes and flank sequences) used in the singleplex experiment. Under description, the following elements are indicated: Connector (Con) sequences are 50 bp DNA sequences that are required for in vivo recombination as described in WO2013144257A1. The promoter including the relative expected expression strengths (Low p = low strength promoter, Med p = medium strength promoter, Strong p = high strength promoter). Promoters originated from *S. cerevisiae* or *K. lactis*. The *K. lactis* promoter KlYdr1p originated from KLLA0F20031g. The ORF name, crtE, crtYB or crtI, and the terminator sequence (all terminators originate from *S. cerevisiae*). This table includes the SEQ ID NO's of the primers used to obtain the donor DNA sequences by amplification by PCR.

| SEQ ID NO: of donor DNA | Description | Template for PCR | Forward primer | Reverse primer |
|---|---|---|---|---|
| SEQ ID NO: 137 | con5 - Low p (KlTDH2p) - crtE - ScTDH3t - conA | SEQ ID NO: 137 | SEQ ID NO: 155 | SEQ ID NO: 156 |
| SEQ ID NO: 138 | con5 - Med p (KlPGK1p) - crtE - ScTDH3t - conA | SEQ ID NO: 138 | SEQ ID NO: 155 | SEQ ID NO: 156 |
| SEQ ID NO: 139 | con5 - Strong p (ScFBA1p) - crtE - ScTDH3t - conA | SEQ ID NO: 139 | SEQ ID NO: 155 | SEQ ID NO: 156 |
| SEQ ID NO: 140 | conA - Low p (KlYDR1p)- crtYB - ScPDC1t - conB | SEQ ID NO: 140 | SEQ ID NO: 157 | SEQ ID NO: 158 |
| SEQ ID NO: 141 | conA - Med p (KlTEF2p) - crtYB - ScPDC1t - conB | SEQ ID NO: 141 | SEQ ID NO: 157 | SEQ ID NO: 158 |
| SEQ ID NO: 142 | conA - Strong p (ScTEF1p) - crtYB-ScPDC1t - conB | SEQ ID NO: 142 | SEQ ID NO: 157 | SEQ ID NO: 158 |
| SEQ ID NO: 143 | conB - Low p (ScPRE3p) - crtI - ScTAL1t - conC | SEQ ID NO: 143 | n.a. | n.a. |
| SEQ ID NO: 144 | conB - Med p (ScACT1p) - crtI - ScTAL1t - conC | SEQ ID NO: 144 | n.a. | n.a. |
| SEQ ID NO: 145 | conB - Strong p (KlENO1p) - crtI - ScTAL1t - conC | SEQ ID NO: 145 | n.a. | n.a. |
| SEQ ID NO: 146 | conB - Low p (ScPRE3p) - crtI - ScTAL1t - con3 | SEQ ID NO: 143 | SEQ ID NO: 159 | SEQ ID NO: 160 |
| SEQ ID NO: 147 | conB - Med p (ScACT1p) - crtI - ScTAL1t - con3 | SEQ ID NO: 144 | SEQ ID NO: 159 | SEQ ID NO: 160 |
| SEQ ID NO: 148 | conB - Strong p (KlENO1p) - crtI - ScTAL1t - con3 | SEQ ID NO: 145 | SEQ ID NO: 159 | SEQ ID NO: 160 |
| SEQ ID NO: 209 | Flank: 5'INT1 - con5. Part of gBlock_1 and gBlock_2. | n.a. | n.a. | n.a. |
| SEQ ID NO: 210 | Flank: con3 - 3' INT1. Part of gBlock_1 and gBlock_2. | n.a. | n.a. | n.a. |

N.a. not applicable.

The carotenoid gene expression cassettes part of the donor DNA sequences were ordered at DNA 2.0 (Menlo Park, Calif., USA). The sequences are set out in SEQ ID NO: 137 to SEQ ID NO: 145, and were used as template for PCR reactions of which the products were used as donor DNA expression cassettes that were integrated into genomic DNA using the approach described in this example (Vide infra). In this example, a carotenoid gene expression cassette was composed of the following elements:
  (i) at the 5' and 3' positions of the DNA sequence 50 basepair connector sequences are present. The presence of connector sequences allowed in vivo recombination between similar connector sequences that are part of other donor DNA expression cassettes or donor DNA flank sequences as is described in WO2013144257A1. As a result, multiple donor DNA fragments assembled into the genomic DNA at a desired location, as is depicted in FIG. 23.
  (ii) A promoter sequence, which can be homologous (i.e. from *S. cerevisiae*) or heterologous (e.g. from *Kluyveromyces lactis*) and a terminator sequence derived from *S. cerevisiae*, were used to control the expression of the carotenogenic genes crtE, crtYB or crtI. As described in Table 20, the promoters are expected to have different expression strengths, resulting in low, medium or high expression levels of crtE, crtYB or crtI. In other experiments, the relative expression strengths of the promoters used to express crtE, crtYB and crtI were determined (data not shown).

(iii) The crtE, crtYB and crtI nucleotide sequences were codon pair optimized for expression in S. cerevisiae as described in WO2008/000632.

PCR fragments of the donor DNA expression cassette sequences were generated by PCR using Phusion DNA polymerase (New England Biolabs, USA) according to manufacturer's instructions. In case of the expression cassettes of the carotenogenic genes, the synthetic DNA provided by DNA2.0 was used as a template in the PCR reaction, using the specific forward and reverse primer combinations depicted in Table 20. For example, in order to obtain the PCR fragment set out in SEQ ID NO: 137, the synthetic DNA construct provided by DNA2.0 was used as a template, using primer sequences set out in SEQ ID NO: 155 and SEQ ID NO: 156. In total, nine different donor DNA sequences containing the carotenoid gene expression cassettes were generated by PCR, as set out in SEQ ID NO: 137; 138; 139; 140; 141; 142; 146; 147 and 148.

Donor DNA Flank Sequences

The donor DNA flank sequences are part of the flank_DNA-gRNA gBlock sequences (SEQ ID NO: 214 and SEQ ID NO; 215, see also Table 21). The gBlock sequences were ordered at Integrated DNA Technologies, Leuven, Belgium. The flank_DNA-gRNA gBlock sequences consisted of the following elements as depicted in FIG. 27 (for SEQ ID NO: 214) and Figure FIG. 28 (for SEQ ID NO: 215):

i) a 50 basepairs connector sequence,
ii) a right flank sequence with 100 base pairs homology to the INT1 locus in genomic DNA,
iii) one or two BsaI restrictions sites (with a specific orientation, in case of two BsaI restriction sites a 10 basepair DNA sequence is included between the two restriction BsaI sites),
iv) a left flank sequence with 100 basepairs homology to the INT1 locus in genomic DNA,
v) a 50 basepair connector sequence,
vi) one or two BsaI restrictions sites (with a specific orientation, in case of two BsaI restriction sites a 10 basepair DNA sequence is included between the two restriction BsaI sites),
vii) a sequence with 50 basepairs homology to vector pRN1120,
viii) a guide RNA expression cassette containing a genomic target sequence to target CAS9 to the INT1 locus,
ix) and a 50 basepair sequence with homology to vector pRN1120.

The presence of connector sequences allowed in vivo recombination between highly homologous connector sequences that are part of donor DNA expression cassettes as is described in WO2013144257A1. The lengths of the different elements described above are also shown in FIG. 27 and FIG. 28. The nucleotide flanks sequences were derived from yeast strain CEN.PK113-7D (MATa URA3 HIS3 LEU2 TRP1 MAL2-8 SUC2). Strain CEN.PK113-7D is available from the EUROSCARF collection (euroscarf.de, Frankfurt, Germany) or from the Centraal Bureau voor Schimmelcultures (Utrecht, the Netherlands, entry number CBS 8340). The origin of the CEN.PK family of strains is described by van Dijken et al., 2000.

Two gBlock sequences were ordered (Table 21). The gBlock sequence containing two times one BsaI restriction site, was named flank_DNA-gRNA gBlock_1 (SEQ ID NO: 214, FIG. 27). The gBlock sequence containing two times two BsaI restriction sites, was named flank_DNA-gRNA gBlock_2 (SEQ ID NO: 215, FIG. 28).

TABLE 21

Overview of ordered flank_DNA-gRNA gBlock sequences.
Using the indicated primers, the gBlocks can be amplified by PCR.

| Name of gBlock | Description | Template for PCR | Forward primer | Reverse primer |
|---|---|---|---|---|
| flank_DNA-gRNA gBlock_1 (SEQ ID NO: 214) | Right flank-BsaI-Left flank-BsaI-guide RNA | SEQ ID NO: 214 | SEQ ID NO: 211 | SEQ ID NO: 212 |
| flank_DNA-gRNA gBlock_2 (SEQ ID NO: 215) | Right flank-2x BsaI-Left flank-2x BsaI-guide RNA | SEQ ID NO: 215 | SEQ ID NO: 211 | SEQ ID NO: 212 |

The gBlocks were individually ligated into the pCR-BluntII-TOPO vector (Zero Blunt TOPO PCR Cloning Kit, Life Technologies, Grand Island, N.Y., USA) according to manufacturer's instructions.

Guide RNA Expression Cassette

As described above, the guide RNA expression cassettes were part of the flank_DNA-gRNA gBlock sequences. The guide RNA expression cassettes consisted of the SNR52p RNA polymerase III promoter, an INT1 genomic target sequence (SEQ ID NO: 176), the gRNA structural component and the SUP4 3' flanking region as described in DiCarlo et al., 2013. The guide RNA expression cassette, of which the sequence is set out in SEQ ID NO: 213, contained at its 5' end 50 basepairs homology and at its 3' end 50 bp homology with vector pRN1120 (after restriction of the vector with EcoRI and XhoI). The presence of homologous DNA sequences at the 5' and 3' end of the guide RNA cassette will promote assembly of a circular vector in vivo by homologous recombination (gap repair) (Orr-Weaver et al., 1983).

Obtaining PCR Products and Restriction with BsaI

To obtain flank_DNA-gRNA PCR fragments containing the right flank, left flank and guide RNA expression cassette, separated by BsaI restriction sites, the following components were used: the pCR-BluntII-TOPO vector containing the gBlock as template, Phusion DNA polymerase (New England Biolabs, USA), and the primers as set out in SEQ ID NO: 211 and 212. The PCR reaction was performed according to manufacturer's instructions. Both flank_DNA-gRNA PCR fragments (flank_DNA-gRNA_1 derived from flank_DNA-gRNA gBlock_1 and flank_DNA-gRNA_2 derived from flank_DNA-gRNA gBlock_2) were purified using the NuceloSpin Gel and PCR Clean-up kit (Machery-Nagel, distributed by Bioké, Leiden, the Netherlands) according to manufacturer's instructions. After purification, the PCR fragments were restricted using the restriction enzyme BsaI (New England Biolabs) according to manufacturer's instructions. The expected fragment sizes after restriction with BsaI were as shown in Table 22. After restriction with BsaI, the DNA fragments were purified using the NuceloSpin Gel and PCR Clean-up kit (Machery-Nagel, distributed by Bioké, Leiden, the Netherlands) according to manufacturer's instructions. The restricted PCR fragments were also analysed using a 2% agarose gel to confirm correct restriction of the PCR fragments: The 499 and 487 bp band could be seen on the gel, as well as the 145, 156 and 144 and 145 bp bands, although they could not be distinguished by eye, the 40 bp band could not be seen on an agarose gel (data not shown).

TABLE 22

Sizes of the DNA fragments after restriction of the flanks_DNA-gRNA fragments with BsaI.

| PCR fragment | Band sizes after restriction (in bp) |
|---|---|
| flank_DNA-gRNA_1 PCR fragment | 145, 156, 499 |
| flank_DNA-gRNA_2 PCR fragment | 40 (2x) 144, 145, 487 |

Transformation and Singleplex Engineering

After obtaining the three donor DNA fragments (crtE, crtYB and crtI expression cassettes), the two donor DNA flank sequences and the guide RNA expression cassette (that were part of flank_DNA-gRNA_1 PCR fragment or flank_DNA-gRNA_2 PCR fragment), these DNA fragments were transformed to yeast to allow singleplex engineering as described below. The procedure for the singleplex engineering experiments is depicted in FIG. 23 and FIG. 29. Singleplex engineering in this example means the integration of a set of three functional carotenoid gene expression cassettes, being a combination of crtE, crtYB and crtI in order to enable carotenoid production, into one locus of genomic DNA using CRISPR/CAS9.

Prior to transformation, DNA concentrations of the donor DNA's, guide RNA expression cassette and vectors were measured using the NanoDrop (ND-1000 Spectrophotometer, Thermo Scientific).

Vector pSCN061 containing a CAS9 expression cassette was first transformed to S. cerevisiae strain CEN.PK113-7D (MATa URA3 HiS3 LEU2 TRP1 MAL2-8 SUC2) using the LiAc/salmon sperm (SS) carrier DNA/PEG method (Gietz and Woods, 2002).

In the transformation mixture 1 microgram of vector pCNS061 (FIG. 21) was used. The transformation mixture was plated on YPD-agar (10 grams per litre of yeast extract, 20 grams per litre of peptone, 20 grams per litre of dextrose, 20 grams per litre of agar) containing 200 microgram (μg) G418 (Sigma Aldrich, Zwijndrecht, the Netherlands) per ml. After two to four days of growth at 30° C. colonies appeared on the transformation plate. A yeast colony conferring resistance to G418 on the plate, now referred as strain CSNO01, was inoculated on YPD-G418 medium (10 grams per litre of yeast extract, 20 grams per litre of peptone, 20 grams per litre of dextrose, 200 μg G418 (Sigma Aldrich, Zwijndrecht, the Netherlands) per ml). Subsequently, strain CSN001 was transformed with the following DNA fragments using the LiAc/SS carrier DNA/PEG method (Gietz and Woods, 2002):

e) Purified linearized vector pRN1120 (1/10 of the molar mass relative to the guide RNA PCR fragment and the two donor DNA flank sequences after restriction with BsaI), f) a guide RNA expression cassette containing homology at the 5' and 3' end with vector pRN1120 and two flanks sequences (1 equivalent of a molar mass after restriction with BsaI), g) three donor DNA gene expression cassettes (⅕ of the molar mass relative to the guide RNA PCR fragment and the two donor DNA flank sequences after restriction with BsaI).

Note: The PCR fragment containing the right flank, left flank and guide RNA expression cassette was restricted with BsaI and purified as described above. Next, the DNA concentration was measured. The concentration of the purified restricted PCR fragment of flank_DNA-gRNA_1 and flank_DNA-gRNA_2 was set to 1, and the amounts indicated for the linearized vector pRN1120 and donor DNA gene expression cassettes relative to the purified fragments were added in the transformation.

As explained in WO2013144257A1, because of the presence of highly homologous 50 bp connector DNA sequences, the donor DNA expression cassettes and donor DNA flank sequences will assemble to one stretch of DNA at the desired location into the genomic DNA as visualized in FIG. 23. The guide RNA expression cassette, which contains 50 bp homology at the 5' and 50 bp homology at the 3' end with vector pRN1120, will assemble into the linearized vector pRN1120 to form a functional circular vector (depicted in FIG. 29) by in vivo homologous recombination (gap repair, Orr-Weaver et al., 1983), which allows selection of transformants on nourseothricin.

As shown in Table 23, different transformation experiments were performed to determine the effect of introduction of different carotenoid gene expression cassettes at the INT1 integration site on the efficiency of singleplex CRISPR/CAS9 mediated genome engineering in S. cerevisiae. For example in singleplex experiment #01, strain CSN001 was transformed with 1/10 of the molar mass of linearized pRN1120 relative to the guide RNA and flank fragments, 1 equivalent of a molar mass of the guide RNA and flank fragments (part of SEQ ID NO: 214 and 215), and ⅕ of the molar mass of donor DNA expression cassettes (SEQ ID NO: 137; 140 and 146) relative to the guide RNA and flank fragments. In this experiment, CAS9 was targeted to the INT1 locus to create a double stranded break. crtE, crtYB and crtI expressed from low strength promoters were targeted to the INT1 locus, where the double stranded break that was introduced by CAS9 was repaired by the transformed donor DNA PCR fragments consisting of donor DNA flanks and donor DNA expression cassettes (FIG. 23).

The transformation mixtures were plated on YPD-agar (10 grams per litre of yeast extract, 20 grams per litre of peptone, 20 grams per litre of dextrose, 20 grams per litre of agar) containing 200 μg nourseothricin (NatMX, Jena Bioscience, Germany) and 200 μg G418 (Sigma Aldrich, Zwijndrecht, the Netherlands) per ml. After two to four days of growth at 30° C., colonies appeared on the transformation plates.

TABLE 23

Overview of transformation experiments performed in the singleplex experiment. In a first transformation vector pCSN061 was transformed. In a second transformation vector pRN1120, restricted with EcoRI and XhoI, was transformed together with three donor DNA expression cassettes and the BsaI restricted PCR products of flank_DNA-gRNA_1 and flank_DNA-gRNA_2 (see Table 22), which include a guide RNA cassette with overlap with vector pRN1120, and two donor DNA flank sequences containing homology to the INT1 locus and containing connector sequences (see FIG. 28 and FIG. 29).

| Experiment | Description experiment | Vectors | guide RNA | Donor DNA expression cassettes | Donor DNA left and right flank |
|---|---|---|---|---|---|
| #01 singleplex | crt cassettes with low strength promoters to INT1 | pSCN061 pRN1120 (restricted with EcoRI and XhoI) | Part of SEQ ID NO: 214 | SEQ ID NO: 137 SEQ ID NO: 140 SEQ ID NO: 146 | Part of SEQ ID NO: 214 |
| #02 singleplex | crt cassettes with medium strength promoters to INT1 | pSCN061 pRN1120 (restricted with EcoRI and XhoI) | Part of SEQ ID NO: 214 | SEQ ID NO: 138 SEQ ID NO: 141 SEQ ID NO: 147 | Part of SEQ ID NO: 214 |
| #03 singleplex | crt cassettes with high strength promoters to INT1 | pSCN061 pRN1120 (restricted with EcoRI and XhoI) | Part of SEQ ID NO: 214 | SEQ ID NO: 139 SEQ ID NO: 142 SEQ ID NO: 148 | Part of SEQ ID NO: 214 |
| #04 singleplex | crt cassettes with low strength promoters to INT1 | pSCN061 pRN1120 (restricted with EcoRI and XhoI) | Part of SEQ ID NO: 215 | SEQ ID NO: 137 SEQ ID NO: 140 SEQ ID NO: 146 | Part of SEQ ID NO: 215 |
| #05 singleplex | crt cassettes with medium strength promoters to INT1 | pSCN061 pRN1120 (restricted with EcoRI and XhoI) | Part of SEQ ID NO: 215 | SEQ ID NO: 138 SEQ ID NO: 141 SEQ ID NO: 147 | Part of SEQ ID NO: 215 |
| #06 singleplex | crt cassettes with high strength promoters to INT1 | pSCN061 pRN1120 (restricted with EcoRI and XhoI) | Part of SEQ ID NO: 215 | SEQ ID NO: 139 SEQ ID NO: 142 SEQ ID NO: 148 | Part of SEQ ID NO: 215 |

The presence of a connector 5 sequence at the crtE expression cassette and the presence of a connector 3 sequence at the crtI expression cassette allows for flexibility in choosing the desired integration locus. Any integration site can be targeted by changing the genomic target sequence (that is part of the guide RNA expression cassette) to a desired integration site, while including a 5' flank (integration site)-con5 and a con3-3' flank (integration site) PCR fragment in the transformation mixture together with the three donor DNA expression cassettes, the guide RNA expression cassette and the linearized vector pRN1120, as illustrated in FIG. 29.

Singleplex Integration Efficiencies

Transformation of crtE, crtYB and crtI expression cassettes resulted in colored transformants, by the integration of the three donor DNA expression cassettes and donor DNA flank sequences that are used to enable targeting to the desired locus into genomic DNA. After transformation, the total number of colonies on a transformation plate were counted. The transformants were colored and/or non-colored. In case of colored transformants, the crtE, crtYB and crtI expression cassettes were successfully integrated into the genomic DNA of the yeast cells. In case of non-colored transformants, crtE, crtYB and crtI expression cassettes were not successfully integrated into the genomic DNA of the yeast cells. The percentage of successfully engineered cells, i.e. transformants that have integrated the crtE, crtYB and crtI expression cassettes into genomic DNA, was calculated by dividing the number of colored transformants by the number of total transformants. The results are indicated in Table 24.

TABLE 24

Percentage colored cells obtained in the different singleplex transformation experiments plated on YPD (2%) + G418 + NatMX agar plates to allow selection on both the CAS9 and guide RNA containing vectors. For the position of the BsaI sites in the gBlocks, see FIG. 28 and FIG. 29.

| Experiment | Description experiment | No. of BsaI sites in the gBlock | % Colored cells | Number of transformants |
|---|---|---|---|---|
| #01 singleplex | crt cassettes with low strength promoters to INT1 | 2 × 1 | 81% | 118 |

TABLE 24-continued

Percentage colored cells obtained in the different singleplex transformation experiments plated on YPD (2%) + G418 + NatMX agar plates to allow selection on both the CAS9 and guide RNA containing vectors. For the position of the BsaI sites in the gBlocks, see FIG. 28 and FIG. 29.

| Experiment | Description experiment | No. of BsaI sites in the gBlock | % Colored cells | Number of transformants |
|---|---|---|---|---|
| #02 singleplex | crt cassettes with medium strength promoters to INT1 | 2 × 1 | 80% | 114 |
| #03 singleplex | crt cassettes with high strength promoters to INT1 | 2 × 1 | 69% | 72 |
| #04 singleplex | crt cassettes with low strength promoters to INT1 | 2 × 2 | 95% | 84 |
| #05 singleplex | crt cassettes with medium strength promoters to INT1 | 2 × 2 | 88% | 75 |
| #06 singleplex | crt cassettes with high strength promoters to INT1 | 2 × 2 | 87% | 62 |

The results in Table 24 demonstrated that three carotenogenic genes can be introduced into genomic DNA by the method described above and as depicted in FIG. 23 and FIG. 29. Independent of the promoters used (low, medium or high strength promoters), colored transformants were obtained indicating the transformants had integrated the donor DNA sequences in the genomic DNA. A number of these transformants were checked for the presence donor DNA cassettes by PCR using a method known by a person skilled in the art. Integration of the donor DNA cassettes at the desired locus and correct assembly of the donor DNA cassettes as depicted in FIG. 23 was confirmed in a number of transformants that were checked (data not shown).

The results demonstrated that in all singleplex experiments in which low (#01, #04) and medium (#02, #05) strength promoters were used, a higher number of transformants were obtained compared to singleplex experiments in which high strength promoters were used (#03, #06). It is expected that a higher strength promoter resulted in higher expression of the crtE, crtYB and crtI proteins and thus higher carotenoid production levels (Table 15 of Example 9). The lower number of transformants in experiment #03 and #06 and the lower percentage of colored transformants in experiment #03 when using high strength promoters might be explained by toxicity of the carotenoids produced, as a specific drug resistance response has been observed previously for S. cerevisiae cells producing higher levels of carotenoid compared to S. cerevisiae cells producing lower levels of carotenoids (Verwaal et al., 2010).

Rather than using 100 bp flank sequences, the flank sequences can be shortened to for example approximately 50 bp or increased to for example approximately 500 bp.

This example clearly shows that the method of the invention allows efficient construction of strains containing multiple genes (pathways) in a single locus. The guide RNA expression cassette and two flank sequences, that determine the site of integration of a pathway, are synthesized as one DNA fragment, in this case a gBlock (Integrated DNA Technologies, Leuven, Belgium). The guide RNA expression cassette and the two flank sequences can be separated by including restriction sites to the fragment, in this case BsaI. The flexibility in choosing a different genomic target, that is part of the guide RNA expression cassette, and choosing the flank sequences, offers a great flexibility in the number of loci In genomic DNA to which the pathway can be integrated.

Example 12: In Vivo Assembly of the Genomic Target Sequence into a Recipient Vector Examples 9 and 11 exemplify the approaches using CRISPR/CAS9 to introduce three donor DNA expression cassettes together with two flank sequences into one genomic DNA locus. In the yeast transformation, a guide RNA expression cassette with homology flanks to the recipient linearized multicopy yeast expression vector, pRN1120, was included. Adding homology flanks to the guide RNA expression cassette will promote reconstitution of a circular vector by in vivo homologous recombination (gap repair) (Orr-Weaver et al., 1983). In this example, a modification is described in which only the genomic target sequence, flanked by sequences that are homologous to a recipient vector is transformed rather than a complete guide RNA expression cassette (consisting of a SNR52p, genomic target, gRNA structural component and the SUP4 3' flanking region, together with flanks sequences homologous to the linearized multicopy yeast expression vector pRN1120). The recipient vector, named pRN1120+, contains "constant parts" of the guide RNA expression cassette, being the SNR52p RNA polymerase III promoter, the gRNA structural component and the SUP4 3' flanking region as described in DiCarlo et al., 2013. The approach is further described below.

Obtaining Vector pRN1120+

A gBlock consisting of the following components was ordered at Integrated DNA Technologies (Leuven, Belgium): 100 bp homology to vector pRN1120, SNR52p RNA polymerase III promoter, EcoRI restriction site sequence, INT1 genomic target sequence, XhoI restriction site sequence, gRNA structural component and the SUP4 3' flanking region, 100 bp homology to vector pRN1120. The sequence of this gBlock is set out in SEQ ID NO: 216. The gBlock sequence can be ligated into the pCR-BluntII-TOPO vector (Zero Blunt TOPO PCR Cloning Kit, Life Technologies, Grand Island, N.Y., USA) according to manufacturer's instructions. The resulting vector can be used as a template in a PCR reaction using appropriate primer to obtain a PCR fragment of the gBlock.

Plasmid pRN1120 (SEQ ID NO: 136, FIG. 22) is restricted using EcoRI and XhoI to obtain a linearized vector. The linearized vector is transformed to yeast strain CEN.PK113-7D (MATa URA3 HIS3 LEU2 TRP1 MAL2-8 SUC2) together with the PCR fragment of the gBlock (SEQ ID NO: 216), which can assemble into the linearized vector pRN1120 to form a functional circular vector by in vivo homologous recombination (gap repair, Orr-Weaver et al., 1983), which allows selection of transformants on nourseothricin, resulting in vector pRN1120+(SEQ ID NO: 217, FIG. 30). The transformation mixtures are plated on YPD-agar (10 grams per litre of yeast extract, 20 grams per litre of peptone, 20 grams per litre of dextrose, 20 grams per litre of agar) containing 200 µg nourseothricin (NatMX, Jena Bioscience, Germany) per ml. After two to four days of growth at 30° C., colonies will appear on the transformation plates. Subsequently, vector pRN1120+ is rescued from a NatMX resistant colony. The NatMX resistant yeast colony is grown overnight at 30 degrees Celsius, 250 rpm in liquid YEPD medium, containing 10 grams per litre of yeast extract, 20 grams per litre of peptone, 20 grams per litre of dextrose, supplemented with 200 μg per ml nourseothricin. Vector DNA isolation is performed on the yeast culture using the NucleoSpin plasmid kit (Machery Nagel, distributed by Bioké, Leiden, the Netherlands). To efficiently open the yeast cells during the plasmid isolation procedure, 50 units zymolyase (0.2 U/μl, Zymo Research, distributed by Baseclear Lab Products, Leiden, the Netherlands) is added to resuspension buffer A1, the cells are incubated with zymolyase for 30 minutes at 37 degrees Celsius. After zymolyase treatment, the plasmid isolation procedure is continued as described in the supplier's manual. Subsequently 2 μl of the isolated plasmid DNA is used for transformation of *E. coli* NEB 10-beta competent cells (High Efficiency, New England Biolabs, distributed by Bioké, Leiden, the Netherlands). The heatshock, 30 seconds at 42 degrees Celsius, is followed by recovery of the cells in 250 μl SOC medium (supplied with the competent cells by New England Biolabs, distributed by Bioké, Leiden, the Netherlands) and the transformation mixture is plated on 2×TY agar plates (16 grams per litre tryptone peptone, 10 grams per litre yeast extract, 5 grams per litre NaCl, 15 grams per litre granulated agar) supplemented with 100 ug/ml ampicillin (Sigma-Aldrich, Zwijndrecht, the Netherlands). Plates are incubated overnight at 37 degrees Celsius.

The resulting *E. coli* transformants are grown in 2× TY (16 grams per litre tryptone peptone, 10 grams per litre yeast extract, 5 grams per litre NaCl)+100 ug/ml ampicillin (Sigma-Aldrich, Zwijndrecht, the Netherlands) overnight at 37 degrees Celsius 250 rpm and subsequently cells are used for plasmid isolation using the NucleoSpin plasmid kit (Machery Nagel, distributed by Bioké, Leiden, the Netherlands) according to supplier's manual. The resulting vector, named pRN1120+, is depicted in FIG. 30 and the sequence is set out in SEQ ID NO: 217.

Transformation Approach

The transformation approach is depicted in FIG. 31. As an example, transformation of three carotenogenic genes to the INT1 locus (see Example 9 for a description of this locus), is described below. First, a vector containing CAS9 is transformed to strain CEN.PK113-7D and a transformant expressing CAS9 is isolated as described in Example 9. Subsequently the CAS9 expressing yeast transformant is transformed with the following components:

i) Two donor DNA flank sequences each containing connector sequences. The two flank sequences can either be:
  a. PCR fragments as obtained using the approach described in Example 9, or,
  b. fragments obtained after BsaI restriction of a gBlock consisting of a right flank sequence, left flank sequence and genomic target sequence with homology to a recipient vector (as described below under iii b), which is a variant of the flank_DNA-gRNA gBlocks described in Example 11. The sequence of these flank_DNA-gRNA gBlocks are set out in SEQ ID NO: 218 (flank_DNA-gRNA gBlock_3, 2×1 BsaI site) or SEQ ID NO: 219 (flank_DNA-gRNA gBlock_4, 2×2 BsaI sites).

ii) Three donor DNA expression cassettes, being crtE, crtYB and crtI expression cassettes, that are described in Example 9.

iii) An INT1 genomic target sequence with homology to vector pRN1120+. This sequence can either be:
  a. A PCR fragment of a gBlock, of which the sequence is set out in SEQ ID NO: 220, or,
  b. fragments obtained after BsaI restriction of a gBlock consisting of a right flank sequence, left flank sequence and genomic target sequence with homology to a recipient vector, which is a variant of the flank_DNA-gRNA gBlocks described in Example 11. The sequence of these flank_DNA-gRNA gBlocks are set out in SEQ ID NO: 218 (flank_DNA-gRNA gBlock_3, 2×1 BsaI site) or SEQ ID NO: 219 (flank_DNA-gRNA gBlock_4, 2×2 BsaI sites).

iv) Linearized vector pRN1120+. Vector pRN1120+ is restricted with the restriction enzymes EcoRI and XhoI. Next, the linearized vector is purified using the NucleoSpin Gel and PCR Clean-up kit (Machery-Nagel, distributed by Doke, Leiden, the Netherlands) according to manufacturer's instructions.

All PCR fragments or restricted PCR fragments are purified using the NucleoSpin Gel and PCR Clean-up kit (Machery-Nagel, distributed by Bioké, Leiden, the Netherlands) according to manufacturer's instructions. Transformation procedures are provided in Example 9 (for components i a, ii, iii a and iv) and Example 11 (for components i b, ii, iii b and iv). As explained in WO2013144257A1, because of the presence of highly homologous 50 bp connector DNA sequences, the donor DNA expression cassettes and donor DNA flank sequences will assemble to one stretch of DNA at the desired location into the genomic DNA as visualized in FIG. 23. The INT1 genomic target, which contains 50 bp homology at the 5' and 50 bp homology at the 3' end with vector pRN1120+, will assemble into the linearized vector pRN1120+ to form a functional circular vector (FIG. 31) by in vivo homologous recombination (gap repair, Orr-Weaver et al., 1983), which allows selection of transformants on nourseothricin.

Colored transformants will appear on the transformation plates, which can be further analyzed by PCR for correct integration of the donor DNA sequences in genomic DNA as explained in Example 9 and Example 11. Alternatively, the colored transformants are analyzed for carotenoid production as explained in Example 9.

The advantage of this approach is that rather than using a full guide RNA expression cassette including homology with vector pRN1120, as for example provided in SEQ ID NO: 173, a much smaller fragment in which the guide RNA part just consisting of the 20 bp genomic target sequence plus homology with vector pRN1120+, needs to be transformed. The presence of a connector 5 sequence at the crtEexpression cassette and the presence of a connector 3 sequence at the crtI expression cassette allows for flexibility in choosing the desired integration locus. Any integration site can be targeted by changing the genomic target sequence to a desired integration site, while including a 5' flank (integration site)-con5 and a con3-3' flank (integration site) fragment in the transformation mixture together with the three donor DNA expression cassettes, the genomic target sequence. and the linearized vector pRN1120+, as illustrated in FIG. 31. Donor DNA sequence(s) can be any DNA sequence of interest and is not restricted to carotenoid expression cassettes as described in this example. This approach also allows for library approaches, by including multiple 20 bp genomic target sequences with homology to pRN1120+ and corresponding flank DNA sequences including connector sequences in the transformation.

Example 13. Deletion of Up to 10 kb of Genomic DNA by Including Multiple Flank Sequences in the Transformation Using CRISPR/CAS9

As explained in Example 8, up to 10 kB of genomic DNA can be deleted using one genomic target. By including two fixed flank sequences in each transformation, either 1 kb (1000 base pairs (bp), 3 kb or 10 kb of genomic DNA around the INT1 locus was deleted. The purpose of Example 12 is to delete parts of genomic DNA in a non-fixed manner by including multiple flank sequences in the transformation, as such that different parts of genomic DNA can be deleted by the approach explained below. This can be achieved by transformation of a pool of so called flank-guide RNA sequences that, after restriction with BsaI to separate the donor DNA flank sequences and guide RNA expression cassette, integrate into genomic DNA together with a Red Fluoresent Protein (RFP) expression cassette, in order to delete a part of genomic DNA. The DNA flank sequences contain a unique barcode (10 basepair sequence) that can be identified by sequencing to determine which left and right flanks are integrated and to determine which part of genomic DNA is deleted. The procedure to delete up to 10 kB of genomic DNA in a non-fixed manner is as follows:

Step 1: Design and order flank-guide RNA gBlock sequences. The flank-guide RNA sequences are ordered as gBlocks (Integrated DNA Technologies, Leuven, Belgium) and consist of the following components (in the order described below) as depicted in FIG. 32.

50 bp connector 3 sequence (part number 9),
 10 bp unique "barcode" sequence (part number 8),
 20 bp sequence for annealing a reverse primer (part number 7),
 100 bp homology to a right flank, in this case INT1, integration site (part number 6),
 22 bp sequence including two BsaI restriction sites (part number 5),
 100 bp homology to a left flank, in this case INT1, integration site (part number 1),
 20 bp sequence for annealing a forward primer (part number 2),
 10 bp unique "barcode" sequence (part number 3),
 50 bp connector 5 sequence (part number 4),
 22 bp sequence including two BsaI restriction sites (part number 5),
 488 bp sequence consisting of a 50 bp flank sequences homologous to the linearized multicopy yeast expression vector pRN1120 (part number 10), guide RNA expression cassette consisting of SNR52p, INT1 genomic target, guide RNA structural component and the SUP4 3' flanking region (part number 11) and of a 50 bp flank sequences homologous to the linearized multicopy yeast expression vector pRN1120 (part number 12).

Three flank-guide RNA gBlock sequences are ordered (Table 25). The gBlock sequences can be ligated into the pCR-BluntII-TOPO vector as described in Example 9.

TABLE 25 gBlocks ordered. Primers used for amplification by PCR are indicated.

| Name of gBlock | SEQ ID NO: | Description | Primers for PCR amplification |
|---|---|---|---|
| gBlockINT1-100-0-BAR-2 | SEQ ID NO: 221 | RF(+Barcode)-LF(+Barcode)-INT1 guide RNA, 2x Bsa1, direct integration at INT1 | SEQ ID NO: 211 SEQ ID NO: 212 |
| gBlockINT1-100-1500-BAR-2 | SEQ ID NO: 222 | RF(+Barcode)-LF(+Barcode)-INT1 guide RNA, 2x Bsa1, integration 1.5 kB up and downstream of INT1 | SEQ ID NO: 211 SEQ ID NO: 212 |
| gBlockINT1-100-5000-BAR-2 | SEQ ID NO: 223 | RF(+Barcode)-LF(+Barcode)-INT1 guide RNA, 2x Bsa1, integration 5 kB up and downstream of INT1 | SEQ ID NO: 211 SEQ ID NO: 212 |

Step 2: Obtaining flank-guide RNA PCR products as described in Example 11. The templates and primers indicated in Table 25 are included in the PCR reaction. After PCR amplification, the sequences set out in SEQ ID NO: 221, SEQ ID NO: 222 and SEQ ID NO: 223 are obtained and the PCR products are purified as described in Example 11. Subsequently, the PCR products are restricted with BsaI as described in Example 11. The different fragments that are obtained after restriction are schematically depicted in FIG. 32.

PCR amplification of the connector 5-red fluorescence protein (RFP)-connector 3 PCR fragment is described in Example 8 (named fragment 2). The con5-RFP-con3 PCR product is purified as described in Example 9.

Step 3: Yeast transformation is performed as follows and is depicted in FIG. 33: Yeast strain CEN.PK113-7D is transformed with plasmid pCN061, resulting in strain CSN001 expressing CAS9, as described in Example 9. Subsequently, strain CSN001 is transformed with the following DNA fragments, as schematically depicted in FIG. 33 and as described in Example 9 (selection on G418 and nourseothricin plates after transformation). Appropriate amounts of DNA are included in the transformation in line with described elsewhere herein.

a) Purified linearized vector pRN1120. Linearization (restriction of pRN1120 by EcoRI and XhoI) and purification is described in Example 9.

b) Purified connector 5-RFP expression cassette-connector 3 PCR fragment.

c) A mix of purified flank sequences obtained after restriction of the flank-guide RNA PCR products. The DNA fragments shown in Table 26 are present in the transformation.

TABLE 26

Description of the flank sequences that are included in the transformation. The transformation approach is schematically depicted in FIG. 33. The chromosomal location of the INT1 locus is described in Example 9. Con denotes 50 bp connector sequences. The barcode sequence is included for sequencing purposes as explained below.

| Flank name | Flank description | Integrated at | Barcode sequence (10 bp) |
|---|---|---|---|
| A | LF_INT1-100-0-con5 | Directly at INT1 locus | CAGTCAGTCA |
| B | LF_INT1-100-1500-con5 | 1500 bp upstream of INT1 | CAGTCAGTAC |
| C | LF_INT1-100-5000-con5 | 5000 bp upstream of INT1 | CAGTCAGTAA |
| D | RF_INT1-100-0-con3 | Directly at INT1 locus | CAGTCAGTGG |
| E | RF_INT1-100-1500-con3 | 1500 bp downstream of INT1 | CAGTCAGTGC |
| F | RF_INT1-100-5000-con3 | 5000 bp downstream of INT1 | CAGTCAGTCC | d) The guide RNA expression cassette with homology to linearized pRN1120 (SEQ ID NO: 213), which is able to recombine into the linearized pRN1120 vector by in vivo recombination by gap repair (Orr-Weaver et al., 1983). The guide RNA will target the CAS9 protein to the INT1 locus, that cleaves the genomic DNA. SEQ ID NO: 213 is part of SEQ ID NO: 221, SEQ ID NO: 222 and SEQ ID NO: 223.

Step 4: After two to four days of growth at 30° C., colonies (red colored and some white colored) appeared on the plates. By UV light (Qpix 450 Colony Picker—Molecular devices LLC) a discrimination was made between red fluorescent colonies, indicating RFP integration, and white colonies, indicating no RFP integration, that appeared on the plates.

A LF-Con5 fragment, the con5-RFP-con3 fragment, and a con3-RF fragment will integrate into genomic DNA at the INT1 locus with by the principle described in Example 8. In Example 8, in each transformation just two flank sequences were included, allowing integration of the FRP expression cassette at the INT1 locus, or to delete 1000 bp, 3000 bp or 10000 bp of genomic DNA around the INT1 genomic target (see FIG. 17). Because in Example 13 all LF sequences present in the transformation mixture contain a con5 sequence and all RF sequences present in the transformation mixture contain a con3 sequence, nine different combinations with the con5-RFP-con3 fragment can be formed, in order to delete different lengths of genomic DNA surrounding the INT1 locus (Table 27 and schematically depicted in FIG. 34).

TABLE 27

Deletions possible after transformation of all LF-Con5 fragments, all con3-RF fragments and the con5-RFP-con3 fragment in the approach depicted in FIG. 35.

| Combination of | | |
|---|---|---|
| Flank | with flank | Deletion achieved |
| A | D | 0 bp (direct integration at INT1) |
| A | E | 1500 bp |
| A | F | 5000 bp |
| B | D | 1500 bp |
| B | E | 3000 bp |
| B | F | 6500 bp |
| C | D | 5000 bp |
| C | E | 6500 bp |
| C | F | 10000 bp |

Step 5: To determine which flank sequences have integrated into genomic DNA, and to determine which part of genomic DNA is deleted, chromosomal DNA of red fluorescent transformants was isolated as described in Example 8. The chromosomal DNA is used as template in a PCR reaction. PCR reactions and analysis of the PCR products on an agarose gel were performed according to a personal skilled in the art. The following primer sets are used (see FIG. 35 for a depiction of the primer annealing positions).

A PCR fragment to confirm integration of the RFP cassette: primer E (SEQ ID NO: 224) and primer F (SEQ ID NO: 225).

To obtain a PCR fragment 1 of the left flank including a barcode sequence (Table 26): primer A (SEQ ID NO: 226) and, for example, primer B (SEQ ID NO: 227).

To obtain a PCR fragment 2 of the right flank including a barcode sequence (Table 26): for example primer C (SEQ ID NO: 228) and primer D (SEQ ID NO: 229).

Next, PCR fragment 1 and PCR fragment 2 are used in a sequencing reaction. The sequencing kit of Applied Biosystems (supplied by Life Technologies, Bleiswijk, the Netherlands) is used according to the manual. To determine the barcode present in the left flank (sequence 3 depicted in FIG. 32 and FIG. 35), for example primer B (SEQ ID NO: 227) is included in the reaction and PCR fragment 1 is used as template. To determine the barcode present in the right flank (sequence 3 depicted in FIG. 32 and FIG. 35), for example primer C (SEQ ID NO: 228) is included in the reaction and PCR fragment 2 is used as template. The PCR fragment used for sequencing is cleaned by ethanol/EDTA precipitation according to supplier's manual. The PCR fragments are pelleted in 10 μl HiDi Formamide of Applied Biosystems supplied by Life Technologies, Bleiswijk, the Netherlands) and the suspension used for sequence analysis with the 3500 Genetic Analyzer of Applied Biosystems (Sanger sequencer).

Interpretation of the sequencing results will determine which flank sequences have integrated into genomic DNA, and will demonstrate which part of genomic DNA is deleted. For example, when flank C (left flank) and flank D (right flank) (Table 27, FIG. 34) integrate together with the RFP expression cassette, the sequencing results will demonstrate that barcode sequence CAGTCAGTAA (Table 26) is present in PCR fragment 1 (flank C), and barcode sequence CAGTCAGTGG (Table 26) is present in PCR fragment 2 (flank D), indicating that approximately 5000 bp of genomic DNA is deleted. For example, when flank B (left flank) and flank F (right flank) (Table 27, FIG. 34) integrate together with the RFP expression cassette, the sequencing results will demonstrate that barcode sequence CAGTCAGTAC (Table 26) is present in PCR fragment 1 (flank B), and barcode sequence CAGTCAGTCC (Table 26) is present in PCR fragment 2 (flank F), indicating that approximately 6500 bp of genomic DNA is deleted. For example, when flank C (left flank) and flank F (right flank) (Table 27, FIG. 34) integrate together with the RFP expression cassette, the sequencing results will demonstrate that barcode sequence CAGTCAGTAA (Table 26) is present in PCR fragment 1 (flank C), and barcode sequence CAGTCAGTCC (Table 26) is present in PCR fragment 2 (flank F), indicating that approximately 10000 bp of genomic DNA is deleted.

The approach described in this example may not be limited by including three left flank and three right flank sequences in the transformation as depicted in FIG. 33: including more than three fragments, for example 10 or 100 or more, will result even more options to delete parts of chromosomal DNA. Also, the approach described is not limited to deletion of maximally approximately 10000 bp of chromosomal DNA, as larger parts can be deleted when flanks further more than approximately 5000 bp upstream or more than approximately 5000 bp downstream of the INT1 genomic target sequence are chosen. Alternatively, other genomic target sequences, that are part of the guide RNA expression cassette (FIG. 32, part of part 11), can be used to increase the number of possible deletion combinations, once the correct genomic target and flank sequences are chosen.

The approach described in this example may for example be used to screen for improved production of a compound of interest by deletion of parts of genomic DNA in a randomized way. After an improved producer is identified, by using a PCR and sequencing approach it can be determined which parts of DNA are deleted as described herein.

REFERENCES

Aleksenko and Clutterbuck. Fungal Genet. Biol. 1997 21: 373-397. Autonomous plasmid replication in *Aspergillus nidulans*: AMA1 and MATE elements.
Barnes et al., siRNA as a molecular tool for use in *Aspergillus niger* (2008) Biotechnology Letters 30 (5): 885-890.
Becker and Guarente, In Abelson, J. N. and Simon, M. I., editors, Guide to Yeast Genetics and Molecular Biology, Methods in Enzymology, Volume 194, 182-187, Academic Press, Inc., New York.
Beetham P R, Kipp P B, Sawycky X L, Arntzen C J and May G D. PNAS 1999, 96, 8774-8778. A tool for functional plant genomics: Chimeric RNA/DNA oligonucleotides cause in vivo gene-specific mutations.
Christianson T W, Sikorski R S, Dante M, Shero J H, Hieter P. Gene. 1992 Jan. 2; 110(1):119-22. Multifunctional yeast high-copy-number shuttle vectors.
Crook N C, Schmitz A C, Alper H S. ACS Synth Biol. 2014 16; 3(5):307-13. Optimization of a yeast RNA interference system for controlling gene expression and enabling rapid metabolic engineering.
DiCarlo J E, Norville J E, Mali P, Rios X, Aach J, Church G M. Nucleic Acids Res. 2013 April; 41(7):4336-43. Genome engineering in *Saccharomyces cerevisiae* using CRISPR-Cas systems.
Dong C, Beetham P, Vincent K and Sharp P. 2006 Plant Cell Rep 25: 457-465. Oligonucleotide-directed gene repair in wheat using a transient plasmid repair assay system.
Durai S, Mani M, Kandavelou K, Wu J, Porteus M, Chandrasegaran S. Nucleic Acids Res 2005 33 (18): 5978-90. Zinc finger nucleases: custom-designed molecular scissors for genome engineering of plant and mammalian cells.
Eldahshan O A and Singab A N B. Journal of Pharmacognosy and Phytochemistry. Vol 2, no 1, 2013. Carotenoids.
Flagfeldt D B, Siewers V, Huang L, Nielsen J. Yeast. 2009 October; 26(10):545-51. Characterization of chromosomal integration sites for heterologous gene expression in *Saccharomyces cerevisiae*.
Gaj T, Gersbach, C and Barbas C. Trends in Biotechnology, 2013, Vol. 31, No. 7 397-405. ZFN, TALEN, and CRISPR/Cas-based methods for genome engineering.
Gao Y and Zhao Y. J Integr Plant Biol. 2014 April; 56(4): 343-9. Self-processing of ribozyme-flanked RNAs into guide RNAs in vitro and in vivo for CRISPR-mediated genome editing.
Gietz R D, Woods R A. Methods Enzymol. 2002; 350:87-96. Transformation of yeast by lithium acetate/single-stranded carrier DNA/polyethylene glycol method.
Goldstein, A. L., and McCusker, J. H. Yeast 1999. 15, 1541-15. Three new dominant drug resistance cassettes for gene disruption in *Saccharomyces cerevisiae*.
Guilinger J P, Thompson D B, Liu D R. Nat Biotechnol. 2014 577-582. Fusion of catalytically inactive Cas9 to FokI nuclease improves the specificity of genome modification.
Güldener, U., Heck, S., Fiedler, T., Beinhauer, J., and Hegemann, J. H. Nucleic Acids Research 1996. 24, 2519-2524. A new efficient gene disruption cassette for repeated use in budding yeast.
Horwitz A A, Walter J M, Schubert M G, Kung S H. Cell Syst. 2015; 1:1-9. Efficient multiplexed integration of synergistic alleles and metabolic pathways in yeasts via CRISPR-Cas.
Hsu P D, Lander E S, Zhang F. Cell. 2014 Jun. 5; 157(6): 1262-78. Development and applications of CRISPR-Cas9 for genome engineering.
Ito et al., 1983, Journal of Bacteriology 153: 163.
Jacobs J Z, Ciccaglione K M, Tournier V, Zaratiegui M. Nat Commun. 2014 Oct. 29; 5:5344. Implementation of the CRISPR-Cas9 system in fission yeast.
Jørgensen T R, Park J, Arentshorst M, van Welzen A M, Lamers G, Vankuyk P A, Damveld R A, van den Hondel C A, Nielsen K F, Frisvad J C, Ram A F. Fungal Genet Biol. 2011 May; 48(5):544-53. The molecular and genetic basis of conidial pigmentation in *Aspergillus niger*.

Kornberg R. Trends in Cell Biology 1999 9 (12): M46 Eukaryotic transcriptional control.

Kuijpers et al. Microbial Cell Factories 2013, 12:47. A versatile, efficient strategy for assembly of multi-fragment expression vectors in *Saccharomyces cerevisiae* using 60 bp synthetic recombination sequences.

Larson, M. H.; Gilbert, L. A.; Wang, X; Lim, W. A.; Weissman, J. S.; Qi, L. S. Nature Protocols 2013 8 (11) 2180-96. CRISPR interference (CRISPRi) for sequence-specific control of gene expression.

Lõoke M, Kristjuhan K, Kristjuhan A. Biotechniques. 2011 May; 50(5):325-8. Extraction of genomic DNA from yeasts for PCR-based applications.

*Mali* P, Yang L, Esvelt K M, Aach J, Guell M, DiCarlo J E, Norville J E, Church G M. Science. 2013 Feb. 15; 339(6121):823-6. RNA-guided human genome engineering via Cas9.

Marck C, Kachouri-Lafond R, Lafontaine I, Westhof E, Dujon B, Grosjean H. Nucleic Acids Res. 2006 Apr. 5; 34(6):1816-35. The RNA polymerase III-dependent family of genes in hemiascomycetes: comparative RNomics, dEcoding strategies, transcription and evolutionary implications.

Meléndez-Martinez A J, Mapelli-Brahm P, Benitez-Gonzalez A, Stinco C M. Arch Biochem Biophys. 2015 Apr. 15; 572:188-200. A comprehensive review on the colorless carotenoids phytoene and phytofluene.

Mitchell L A, Chuang J, Agmon N, Khunsriraksakul C, Phillips N A, Cai Y, Truong D M, Veerakumar A, Wang Y, Mayorga M, Blomquist P, Sadda P, Trueheart J, Boeke J D. Nucleic Acids Res. 2015 Jul. 27; 43(13):6620-30. Versatile genetic assembly system (VEGAS) to assemble pathways for expression in *S. cerevisiae*.

Mouyna I, Henry C, Doering T L, Latge J P. FEMS Microbiol Lett. 2004 Aug. 15; 237(2):317-24. Gene silencing with RNA interference in the human pathogenic fungus *Aspergillus fumigatus*.

Nakamura, Y., et al. Nucl. Acids Res. 2000 28:292. Codon usage tabulated from the international DNA sequence databases: status for the year 2000.

Oliveira et al., Efficient cloning system for construction of gene silencing vectors in *Aspergillus niger* (2008) Appl. Microbiol. and Biotechnol. 80 (5): 917-924.

Orr-Weaver T L, Szostak J W, Rothstein R J. Methods Enzymol. 1983; 101:228-45. Genetic applications of yeast transformation with linear and gapped plasmids.

Ran F A, Hsu P D, Lin C Y, Gootenberg J S, Konermann S, Trevino A E, Scott D A, Inoue A, Matoba S, Zhang Y, Zhang F. Cell 2013 154, 1380-1389. Double nicking by RNA-guided CRISPR Cas9 for enhanced genome editing specificity.

Sander J D, Joung J K. Nat Biotechnol. 2014 April; 32(4): 347-55. doi: 10.1038/nbt.2842. Epub 2014 Mar. 2. CRISPR-Cas systems for editing, regulating and targeting genomes.

Shi J, Le Maguer M. Crit Rev Biotechnol. 2000; 20(4):293-334. Lycopene in tomatoes: chemical and physical properties affected by food processing.

Sikorski R S, Hieter P. Genetics. 1989 May; 122(1):19-27. A system of shuttle vectors and yeast host strains designed for efficient manipulation of DNA in *Saccharomyces cerevisiae*.

Ryan O W, Skerker J M, Maurer M J, Li X, Tsai J C, Poddar S, Lee M E, DeLoache W, Dueber J E, Arkin A P, Cate J H. Elife. 2014. 19; 3. 03703.

Tsai S Q, Wyvekens N, Khayter C, et al. Nat Biotechnol. 2014 32(6):569-576. Dimeric CRISPR RNA-guided FokI nucleases for highly specific genome editing.

van Dijken J P, Bauer J, Brambilla L, Duboc P, Francois J M, Gancedo C, Giuseppin M L, Heijnen J J, Hoare M, Lange H C, Madden E A, Niederberger P, Nielsen J, Parrou J L, Petit T, Porro D, Reuss M, van Riel N, Rizzi M, Steensma H Y, Verrips C T, Vindelov J, Pronk J T. An interlaboratory comparison of physiological and genetic properties of four *Saccharomyces cerevisiae* strains. Enzyme Microb Technol. 2000 Jun. 1; 26(9-10):706-714.

Verduyn C, Postma E, Scheffers W A, Van Dijken J P. Yeast. 1992 July; 8(7):501-17. Effect of benzoic acid on metabolic fluxes in yeasts: a continuous-culture study on the regulation of respiration and alcoholic fermentation.

Verwaal R, Wang J, Meijnen J P, Visser H, Sandmann G, van den Berg J A, van Ooyen A J. Appl Environ Microbiol. 2007 July; 73(13):4342-50. Epub 2007 May 11. High-level production of beta-carotene in *Saccharomyces cerevisiae* by successive transformation with carotenogenic genes from *Xanthophyllomyces dendrorhous*.

Verwaal R, Jiang Y, Wang J, Daran J M, Sandmann G, van den Berg J A, van Ooyen A J. Yeast. 2010 December; 27(12):983-98. Heterologous carotenoid production in *Saccharomyces cerevisiae* induces the pleiotropic drug resistance stress response.

Wah, D. A.; J. Bitinaite, Schildkraut, I., Aggarwal, A. K. Proc Natl Acad Sci USA 1998 95 (18): 10564-9. Structure of FokI has implications for DNA cleavage.

Zhang G, Kong I I, Kim H, Liu J, Cate J H, Jin Y S. Appl Environ Microbiol. 2014 Dec. 15; 80(24):7694-701. doi: 10.1128/AEM.02310-14. Epub 2014 Oct. 3. Construction of a quadruple auxotrophic mutant of an industrial polyploidy *Saccharomyces cerevisiae* using RNA-guided Cas9 nuclease.

SEQUENCE LISTING (229 sequences)

SEQ ID NO: 1-4 - skipped (4 entries)

SEQ ID NO: 5 - DNA, 11999069 bp, Saccharomyces cerevisiae CEN.PK113-7D (residues 1-1,999,845 of 11,999,069)
  misc_feature (205)..(2527): n is a, c, g, or t
  misc_feature (44386)..(44432): n is a, c, g, or t
  misc_feature (45928)..(45971): n is a, c, g, or t
  misc_feature (81641)..(81756): n is a, c, g, or t
  misc_feature (163081)..(174880): n is a, c, g, or t
  misc_feature (233286)..(233295): n is a, c, g, or t
  misc_feature (233896)..(234083): n is a, c, g, or t
  misc_feature (361462)..(372712): n is a, c, g, or t
  misc_feature (475262)..(475374): n is a, c, g, or t
  misc_feature (498298)..(498620): n is a, c, g, or t
  misc_feature (499040)..(499060): n is a, c, g, or t
  misc_feature (504686)..(504874): n is a, c, g, or t
  misc_feature (594168)..(594491): n is a, c, g, or t
  misc_feature (595072)..(595412): n is a, c, g, or t
  misc_feature (596424)..(596433): n is a, c, g, or t
  misc_feature (596712)..(596721): n is a, c, g, or t
  misc_feature (597302)..(598002): n is a, c, g, or t
  misc_feature (620254)..(620310): n is a, c, g, or t
  misc_feature (627246)..(627321): n is a, c, g, or t
  misc_feature (639566)..(639604): n is a, c, g, or t
  misc_feature (641524)..(641565): n is a, c, g, or t
  misc_feature (671276)..(671329): n is a, c, g, or t
  misc_feature (710578)..(710621): n is a, c, g, or t
  misc_feature (766972)..(767018): n is a, c, g, or t
  misc_feature (782945)..(783001): n is a, c, g, or t
  misc_feature (803273)..(803728): n is a, c, g, or t
  misc_feature (868403)..(868584): n is a, c, g, or t
  misc_feature (869252)..(869299): n is a, c, g, or t
  misc_feature (902796)..(903022): n is a, c, g, or t
  misc_feature (912357)..(912705): n is a, c, g, or t
  misc_feature (912944)..(913734): n is a, c, g, or t
  misc_feature (915178)..(915187): n is a, c, g, or t
  misc_feature (915499)..(915508): n is a, c, g, or t
  misc_feature (916239)..(916873): n is a, c, g, or t
  misc_feature (944978)..(944998): n is a, c, g, or t
  misc_feature (968410)..(968595): n is a, c, g, or t
  misc_feature (999644)..(999653): n is a, c, g, or t
  misc_feature (1001042)..(1001051): n is a, c, g, or t
  misc_feature (1025818)..(1025891): n is a, c, g, or t
  misc_feature (1162118)..(1167914): n is a, c, g, or t
  misc_feature (1185684)..(1185732): n is a, c, g, or t
  misc_feature (1243517)..(1243540): n is a, c, g, or t
  misc_feature (1277813)..(1278083): n is a, c, g, or t
  misc_feature (1314710)..(1315005): n is a, c, g, or t
  misc_feature (1355228)..(1363676): n is a, c, g, or t
  misc_feature (1364029)..(1392995): n is a, c, g, or t
  misc_feature (1393432)..(1394056): n is a, c, g, or t
  misc_feature (1475609)..(1475666): n is a, c, g, or t
  misc_feature (1496659)..(1502447): n is a, c, g, or t
  misc_feature (1539992)..(1540024): n is a, c, g, or t
  misc_feature (1554740)..(1560671): n is a, c, g, or t
  misc_feature (1590932)..(1591053): n is a, c, g, or t
  misc_feature (1591352)..(1591362): n is a, c, g, or t
  misc_feature (1602548)..(1602576): n is a, c, g, or t
  misc_feature (1635090)..(1635403): n is a, c, g, or t
  misc_feature (1667537)..(1667546): n is a, c, g, or t
  misc_feature (1692520)..(1692637): n is a, c, g, or t
  misc_feature (1726932)..(1727004): n is a, c, g, or t
  misc_feature (1755223)..(1755259): n is a, c, g, or t
  misc_feature (1774771)..(1774828): n is a, c, g, or t
  misc_feature (1785474)..(1785510): n is a, c, g, or t
  misc_feature (1794457)..(1794494): n is a, c, g, or t
  misc_feature (1874271)..(1885107): n is a, c, g, or t
  misc_feature (1889505)..(1889514): n is a, c, g, or t
  misc_feature (1940124)..(1940152): n is a, c, g, or t
  misc_feature (1951370)..(1951379): n is a, c, g, or t
  misc_feature (1963016)..(1963200): n is a, c, g, or t
  misc_feature (1963557)..(1963566): n is a, c, g, or t
  misc_feature (1964069)..(1964078): n is a, c, g, or t
  misc_feature (1966040)..(1966554): n is a, c, g, or t
  misc_feature (1967021)..(1967341): n is a, c, g, or t
  misc_feature (1968461)..(1969491): n is a, c, g, or t
  misc_feature (1970683)..(1970716): n is a, c, g, or t
  misc_feature (1971585)..(1972191): n is a, c, g, or t
  misc_feature (1972656)..(1972665): n is a, c, g, or t
  misc_feature (1992179)..(1992312): n is a, c, g, or t
  misc_feature (2006767)..(2006856): n is a, c, g, or t
  misc_feature (2049135)..(2049170): n is a, c, g, or t
  misc_feature (2054518)..(2054598): n is a, c, g, or t
  misc_feature (2112568)..(2112704): n is a, c, g, or t
  misc_feature (2114839)..(2114918): n is a, c, g, or t
  misc_feature (2134964)..(2134981): n is a, c, g, or t
  misc_feature (2187234)..(2187243): n is a, c, g, or t
  misc_feature (2256573)..(2256582): n is a, c, g, or t
  misc_feature (2355253)..(2355341): n is a, c, g, or t
  misc_feature (2435326)..(2435470): n is a, c, g, or t
  misc_feature (2450266)..(2450328): n is a, c, g, or t
  misc_feature (2478419)..(2478457): n is a, c, g, or t
  misc_feature (2481654)..(2481706): n is a, c, g, or t
  misc_feature (2487760)..(2487918): n is a, c, g, or t
  misc_feature (2541634)..(2541643): n is a, c, g, or t
  misc_feature (2628051)..(2630562): n is a, c, g, or t
  misc_feature (2631310)..(2631319): n is a, c, g, or t
  misc_feature (2631854)..(2631863): n is a, c, g, or t
  misc_feature (2632286)..(2634166): n is a, c, g, or t
  misc_feature (2634511)..(2635178): n is a, c, g, or t
  misc_feature (2638406)..(2638415): n is a, c, g, or t
  misc_feature (2639815)..(2639848): n is a, c, g, or t
  misc_feature (2696790)..(2696803): n is a, c, g, or t
  misc_feature (2728661)..(2728670): n is a, c, g, or t
  misc_feature (2739515)..(2739809): n is a, c, g, or t
  misc_feature (2773301)..(2773382): n is a, c, g, or t
  misc_feature (2816244)..(2822480): n is a, c, g, or t
  misc_feature (2869533)..(2869591): n is a, c, g, or t
  misc_feature (2908333)..(2908363): n is a, c, g, or t
  misc_feature (2973609)..(2973887): n is a, c, g, or t
  misc_feature (2974288)..(2974297): n is a, c, g, or t
  misc_feature (2992902)..(2993306): n is a, c, g, or t
  misc_feature (3043328)..(3043348): n is a, c, g, or t
  misc_feature (3055159)..(3055212): n is a, c, g, or t
  misc_feature (3074812)..(3074821): n is a, c, g, or t
  misc_feature (3076682)..(3076691): n is a, c, g, or t
  misc_feature (3091225)..(3094322): n is a, c, g, or t
  misc_feature (3094651)..(3102601): n is a, c, g, or t
  misc_feature (3144421)..(3144491): n is a, c, g, or t
  misc_feature (3159228)..(3159997): n is a, c, g, or t
  misc_feature (3195677)..(3195691): n is a, c, g, or t
  misc_feature (3258209)..(3258419): n is a, c, g, or t
  misc_feature (3281281)..(3281481): n is a, c, g, or t
  misc_feature (3289944)..(3290004): n is a, c, g, or t
  misc_feature (3320671)..(3321188): n is a, c, g, or t
  misc_feature (3331355)..(3331603): n is a, c, g, or t
  misc_feature (3331866)..(3331875): n is a, c, g, or t
  misc_feature (3332825)..(3333247): n is a, c, g, or t
  misc_feature (3333794)..(3333954): n is a, c, g, or t
  misc_feature (3347120)..(3363602): n is a, c, g, or t
  misc_feature (3365565)..(3376501): n is a, c, g, or t
  misc_feature (3376811)..(3380583): n is a, c, g, or t
  misc_feature (3381762)..(3383298): n is a, c, g, or t
  misc_feature (3420545)..(3422114): n is a, c, g, or t
  misc_feature (3423622)..(3426778): n is a, c, g, or t
  misc_feature (3499871)..(3499882): n is a, c, g, or t
  misc_feature (3500521)..(3500530): n is a, c, g, or t
  misc_feature (3526350)..(3526367): n is a, c, g, or t
  misc_feature (3557063)..(3557072): n is a, c, g, or t
  misc_feature (3625021)..(3625067): n is a, c, g, or t
  misc_feature (3677020)..(3677057): n is a, c, g, or t
  misc_feature (3693178)..(3693223): n is a, c, g, or t
  misc_feature (3741420)..(3741429): n is a, c, g, or t
  misc_feature (3741746)..(3741755): n is a, c, g, or t
  misc_feature (3745978)..(3745987): n is a, c, g, or t
  misc_feature (3752623)..(3752656): n is a, c, g, or t
  misc_feature (3753805)..(3753916): n is a, c, g, or t
  misc_feature (3800996)..(3807228): n is a, c, g, or t
  misc_feature (3867488)..(3867512): n is a, c, g, or t
  misc_feature (3924622)..(3924934): n is a, c, g, or t
  misc_feature (3943036)..(3943045): n is a, c, g, or t
  misc_feature (3944062)..(3944117): n is a, c, g, or t
  misc_feature (3977549)..(3977558): n is a, c, g, or t
  misc_feature (3986649)..(3986913): n is a, c, g, or t
  misc_feature (4064698)..(4066091): n is a, c, g, or t
  misc_feature (4095364)..(4095746): n is a, c, g, or t
  misc_feature (4098982)..(4098991): n is a, c, g, or t
  misc_feature (4141332)..(4141391): n is a, c, g, or t
  misc_feature (4153885)..(4154014): n is a, c, g, or t
  misc_feature (4168860)..(4174683): n is a, c, g, or t
  misc_feature (4178481)..(4178490): n is a, c, g, or t
  misc_feature (4202100)..(4202109): n is a, c, g, or t
  misc_feature (4202416)..(4202425): n is a, c, g, or t
  misc_feature (4202758)..(4203311): n is a, c, g, or t
  misc_feature (4208564)..(4214472): n is a, c, g, or t
  misc_feature (4214816)..(4221031): n is a, c, g, or t
  misc_feature (4233235)..(4233305): n is a, c, g, or t
  misc_feature (4240413)..(4240472): n is a, c, g, or t
  misc_feature (4306916)..(4306925): n is a, c, g, or t
  misc_feature (4328320)..(4328712): n is a, c, g, or t
  misc_feature (4340090)..(4340099): n is a, c, g, or t
  misc_feature (4340461)..(4340470): n is a, c, g, or t
  misc_feature (4342720)..(4344153): n is a, c, g, or t
  misc_feature (4346464)..(4346643): n is a, c, g, or t
  misc_feature (4348250)..(4348471): n is a, c, g, or t
  misc_feature (4471451)..(4477404): n is a, c, g, or t
  misc_feature (4533358)..(4533497): n is a, c, g, or t
  misc_feature (4617992)..(4618023): n is a, c, g, or t
  misc_feature (4661127)..(4661383): n is a, c, g, or t
  misc_feature (4672227)..(4672332): n is a, c, g, or t
  misc_feature (4796633)..(4796677): n is a, c, g, or t
  misc_feature (4808412)..(4808456): n is a, c, g, or t
  misc_feature (4832325)..(4832370): n is a, c, g, or t
  misc_feature (4840231)..(4840325): n is a, c, g, or t
  misc_feature (4892532)..(4894744): n is a, c, g, or t
  misc_feature (4911796)..(4917647): n is a, c, g, or t
  misc_feature (4970685)..(4970703): n is a, c, g, or t
  misc_feature (5021282)..(5027134): n is a, c, g, or t
  misc_feature (5039888)..(5039897): n is a, c, g, or t
  misc_feature (5061345)..(5061354): n is a, c, g, or t
  misc_feature (5140122)..(5140131): n is a, c, g, or t
  misc_feature (5166542)..(5166551): n is a, c, g, or t
  misc_feature (5167261)..(5167270): n is a, c, g, or t
  misc_feature (5261635)..(5261655): n is a, c, g, or t
  misc_feature (5287399)..(5293375): n is a, c, g, or t
  misc_feature (5318126)..(5318173): n is a, c, g, or t
  misc_feature (5348589)..(5348621): n is a, c, g, or t
  misc_feature (5395087)..(5395233): n is a, c, g, or t
  misc_feature (5395557)..(5395588): n is a, c, g, or t
  misc_feature (5395827)..(5395866): n is a, c, g, or t
  misc_feature (5396620)..(5396629): n is a, c, g, or t
  misc_feature (5397322)..(5398079): n is a, c, g, or t
  misc_feature (5398391)..(5399129): n is a, c, g, or t
  misc_feature (5399763)..(5399772): n is a, c, g, or t
  misc_feature (5402565)..(5402594): n is a, c, g, or t
  misc_feature (5403245)..(5411575): n is a, c, g, or t
  misc_feature (5459021)..(5459039): n is a, c, g, or t
  misc_feature (5492249)..(5496564): n is a, c, g, or t
  misc_feature (5497274)..(5498143): n is a, c, g, or t
  misc_feature (5648026)..(5648062): n is a, c, g, or t
  misc_feature (5648923)..(5648932): n is a, c, g, or t
  misc_feature (5679128)..(5679137): n is a, c, g, or t
  misc_feature (5739683)..(5739708): n is a, c, g, or t
  misc_feature (5752652)..(5752661): n is a, c, g, or t
  misc_feature (5754987)..(5755029): n is a, c, g, or t
  misc_feature (5787779)..(5787813): n is a, c, g, or t
  misc_feature (5809061)..(5809070): n is a, c, g, or t
  misc_feature (5810680)..(5810751): n is a, c, g, or t
  misc_feature (5825247)..(5825381): n is a, c, g, or t
  misc_feature (5875057)..(5875092): n is a, c, g, or t
  misc_feature (5882070)..(5882227): n is a, c, g, or t
  misc_feature (5888651)..(5888698): n is a, c, g, or t
  misc_feature (5892024)..(5892096): n is a, c, g, or t
  misc_feature (5894021)..(5894076): n is a, c, g, or t
  misc_feature (5897382)..(5897399): n is a, c, g, or t
  misc_feature (5914919)..(5917786): n is a, c, g, or t
  misc_feature (5918097)..(5920417): n is a, c, g, or t
  misc_feature (5942134)..(5942446): n is a, c, g, or t
  misc_feature (5956982)..(5963365): n is a, c, g, or t
  misc_feature (5965545)..(5965554): n is a, c, g, or t
  misc_feature (5965896)..(5965905): n is a, c, g, or t
  misc_feature (5966394)..(5967458): n is a, c, g, or t
  misc_feature (5968186)..(5969324): n is a, c, g, or t
  misc_feature (5993697)..(5993706): n is a, c, g, or t
  misc_feature (5994847)..(5994856): n is a, c, g, or t
  misc_feature (5995606)..(5995615): n is a, c, g, or t
  misc_feature (5996681)..(5996690): n is a, c, g, or t
  misc_feature (5997179)..(5997519): n is a, c, g, or t
  misc_feature (5999799)..(5999843): n is a, c, g, or t
  misc_feature (6031305)..(6031346): n is a, c, g, or t
  misc_feature (6061367)..(6061505): n is a, c, g, or t
  misc_feature (6062870)..(6062895): n is a, c, g, or t
  misc_feature (6099845)..(6099902): n is a, c, g, or t
  misc_feature (6122169)..(6122366): n is a, c, g, or t
  misc_feature (6146818)..(6146827): n is a, c, g, or t
  misc_feature (6147525)..(6147534): n is a, c, g, or t
  misc_feature (6163386)..(6178290): n is a, c, g, or t
  misc_feature (6195480)..(6195489): n is a, c, g, or t
  misc_feature (6196302)..(6196761): n is a, c, g, or t
  misc_feature (6197179)..(6197432): n is a, c, g, or t
  misc_feature (6258062)..(6258158): n is a, c, g, or t
  misc_feature (6260714)..(6260736): n is a, c, g, or t
  misc_feature (6262813)..(6262909): n is a, c, g, or t
  misc_feature (6269624)..(6269664): n is a, c, g, or t
  misc_feature (6304253)..(6304288): n is a, c, g, or t
  misc_feature (6329435)..(6329511): n is a, c, g, or t
  misc_feature (6369465)..(6369511): n is a, c, g, or t
  misc_feature (6379954)..(6380014): n is a, c, g, or t
  misc_feature (6590763)..(6590959): n is a, c, g, or t
  misc_feature (6591761)..(6592147): n is a, c, g, or t
  misc_feature (6592862)..(6593217): n is a, c, g, or t
  misc_feature (6720747)..(6720796): n is a, c, g, or t
  misc_feature (6724027)..(6724325): n is a, c, g, or t
  misc_feature (6724576)..(6730479): n is a, c, g, or t
  misc_feature (6750715)..(6756572): n is a, c, g, or t
  misc_feature (6757573)..(6759539): n is a, c, g, or t
  misc_feature (6763105)..(6763508): n is a, c, g, or t
  misc_feature (6771910)..(6771929): n is a, c, g, or t
  misc_feature (6791324)..(6791337): n is a, c, g, or t
  misc_feature (6800272)..(6800481): n is a, c, g, or t
  misc_feature (6888678)..(6888703): n is a, c, g, or t
  misc_feature (6895882)..(6896220): n is a, c, g, or t
  misc_feature (6900918)..(6901231): n is a, c, g, or t
  misc_feature (6924669)..(6925006): n is a, c, g, or t
  misc_feature (6931184)..(6931228): n is a, c, g, or t
  misc_feature (6952508)..(6952815): n is a, c, g, or t
  misc_feature (6953148)..(6953157): n is a, c, g, or t
  misc_feature (6953712)..(6953721): n is a, c, g, or t
  misc_feature (6954400)..(6954466): n is a, c, g, or t
  misc_feature (6997493)..(6997502): n is a, c, g, or t
  misc_feature (7000160)..(7007168): n is a, c, g, or t
  misc_feature (7007426)..(7012014): n is a, c, g, or t
  misc_feature (7120372)..(7120384): n is a, c, g, or t
  misc_feature (7137844)..(7137878): n is a, c, g, or t
  misc_feature (7139950)..(7139987): n is a, c, g, or t
  misc_feature (7156736)..(7156788): n is a, c, g, or t
  misc_feature (7232451)..(7232470): n is a, c, g, or t
  misc_feature (7267316)..(7267886): n is a, c, g, or t
  misc_feature (7268847)..(7268889): n is a, c, g, or t
  misc_feature (7269429)..(7269636): n is a, c, g, or t
  misc_feature (7269935)..(7269951): n is a, c, g, or t
  misc_feature (7270484)..(7270788): n is a, c, g, or t
  misc_feature (7275847)..(7276292): n is a, c, g, or t
  misc_feature (7276567)..(7276576): n is a, c, g, or t
  misc_feature (7277068)..(7277077): n is a, c, g, or t
  misc_feature (7321152)..(7321289): n is a, c, g, or t
  misc_feature (7358769)..(7358817): n is a, c, g, or t
  misc_feature (7362636)..(7362653): n is a, c, g, or t
  misc_feature (7367764)..(7367823): n is a, c, g, or t
  misc_feature (7400860)..(7406299): n is a, c, g, or t
  misc_feature (7440914)..(7441098): n is a, c, g, or t
  misc_feature (7444170)..(7444228): n is a, c, g, or t
  misc_feature (7446715)..(7446728): n is a, c, g, or t
  misc_feature (7473211)..(7473242): n is a, c, g, or t
  misc_feature (7533218)..(7538398): n is a, c, g, or t
  misc_feature (7593007)..(7593362): n is a, c, g, or t
  misc_feature (7617361)..(7617557): n is a, c, g, or t
  misc_feature (7666494)..(7666774): n is a, c, g, or t
  misc_feature (7706514)..(7706653): n is a, c, g, or t
  misc_feature (7720385)..(7720428): n is a, c, g, or t
  misc_feature (7727199)..(7727262): n is a, c, g, or t
  misc_feature (7729487)..(7729544): n is a, c, g, or t
  misc_feature (7756776)..(7757013): n is a, c, g, or t
  misc_feature (7836553)..(7836640): n is a, c, g, or t
  misc_feature (7843009)..(7843108): n is a, c, g, or t
  misc_feature (7885148)..(7885356): n is a, c, g, or t
  misc_feature (7893877)..(7894489): n is a, c, g, or t
  misc_feature (7934507)..(7934605): n is a, c, g, or t
  misc_feature (7965027)..(7965759): n is a, c, g, or t
  misc_feature (7974501)..(7980753): n is a, c, g, or t
  misc_feature (8018624)..(8018931): n is a, c, g, or t
  misc_feature (8023503)..(8029062): n is a, c, g, or t
  misc_feature (8075966)..(8075981): n is a, c, g, or t
  misc_feature (8101105)..(8101204): n is a, c, g, or t
  misc_feature (8102080)..(8102089): n is a, c, g, or t
  misc_feature (8102364)..(8102696): n is a, c, g, or t
  misc_feature (8102913)..(8103214): n is a, c, g, or t
  misc_feature (8103941)..(8103950): n is a, c, g, or t
  misc_feature (8116421)..(8116430): n is a, c, g, or t
  misc_feature (8116874)..(8116883): n is a, c, g, or t
  misc_feature (8117158)..(8117648): n is a, c, g, or t
  misc_feature (8120864)..(8120949): n is a, c, g, or t
  misc_feature (8144861)..(8145420): n is a, c, g, or t
  misc_feature (8223914)..(8223923): n is a, c, g, or t
  misc_feature (8326977)..(8327041): n is a, c, g, or t
  misc_feature (8373884)..(8373918): n is a, c, g, or t
  misc_feature (8471232)..(8471278): n is a, c, g, or t
  misc_feature (8572264)..(8572356): n is a, c, g, or t
  misc_feature (8573326)..(8573335): n is a, c, g, or t
  misc_feature (8596432)..(8596573): n is a, c, g, or t
  misc_feature (8613678)..(8619990): n is a, c, g, or t
  misc_feature (8620638)..(8628769): n is a, c, g, or t
  misc_feature (8688269)..(8688308): n is a, c, g, or t
  misc_feature (8707494)..(8707539): n is a, c, g, or t
  misc_feature (8728662)..(8728704): n is a, c, g, or t
  misc_feature (8731205)..(8731240): n is a, c, g, or t
  misc_feature (8731834)..(8731892): n is a, c, g, or t
  misc_feature (8752265)..(8752326): n is a, c, g, or t
  misc_feature (8771873)..(8771903): n is a, c, g, or t
  misc_feature (8851401)..(8861738): n is a, c, g, or t
  misc_feature (8972109)..(8978299): n is a, c, g, or t
  misc_feature (8978580)..(8984473): n is a, c, g, or t
  misc_feature (8992934)..(8992993): n is a, c, g, or t
  misc_feature (9028265)..(9028374): n is a, c, g, or t
  misc_feature (9031349)..(9031448): n is a, c, g, or t
  misc_feature (9081547)..(9092733): n is a, c, g, or t
  misc_feature (9174845)..(9174905): n is a, c, g, or t
  misc_feature (9195859)..(9201769): n is a, c, g, or t
  misc_feature (9238350)..(9238386): n is a, c, g, or t
  misc_feature (9254403)..(9256112): n is a, c, g, or t
  misc_feature (9259790)..(9261506): n is a, c, g, or t
  misc_feature (9306805)..(9312705): n is a, c, g, or t
  misc_feature (9339145)..(9339171): n is a, c, g, or t
  misc_feature (9343321)..(9343330): n is a, c, g, or t
  misc_feature (9345863)..(9345872): n is a, c, g, or t
  misc_feature (9350863)..(9350872): n is a, c, g, or t
  misc_feature (9354674)..(9354708): n is a, c, g, or t
  misc_feature (9407736)..(9408709): n is a, c, g, or t
  misc_feature (9422125)..(9422134): n is a, c, g, or t
  misc_feature (9452776)..(9453061): n is a, c, g, or t
  misc_feature (9457486)..(9457638): n is a, c, g, or t
  misc_feature (9483727)..(9483779): n is a, c, g, or t
  misc_feature (9622958)..(9623434): n is a, c, g, or t
  misc_feature (9623714)..(9623757): n is a, c, g, or t
  misc_feature (9624437)..(9624505): n is a, c, g, or t
  misc_feature (9624848)..(9624912): n is a, c, g, or t
  misc_feature (9629940)..(9629949): n is a, c, g, or t
  misc_feature (9630619)..(9630628): n is a, c, g, or t
  misc_feature (9630946)..(9630955): n is a, c, g, or t
  misc_feature (9631482)..(9631511): n is a, c, g, or t
  misc_feature (9632870)..(9632879): n is a, c, g, or t
  misc_feature (9633302)..(9633840): n is a, c, g, or t
  misc_feature (9636461)..(9636470): n is a, c, g, or t
  misc_feature (9636753)..(9639148): n is a, c, g, or t
  misc_feature (9675363)..(9675598): n is a, c, g, or t
  misc_feature (9684991)..(9685033): n is a, c, g, or t
  misc_feature (9707837)..(9708153): n is a, c, g, or t
  misc_feature (9709196)..(9709523): n is a, c, g, or t
  misc_feature (9709815)..(9715750): n is a, c, g, or t
  misc_feature (9718278)..(9718287): n is a, c, g, or t
  misc_feature (9755015)..(9755480): n is a, c, g, or t
  misc_feature (9773951)..(9776620): n is a, c, g, or t
  misc_feature (9793427)..(9794419): n is a, c, g, or t
  misc_feature (9806315)..(9806324): n is a, c, g, or t
  misc_feature (9823552)..(9823561): n is a, c, g, or t
  misc_feature (9824293)..(9824302): n is a, c, g, or t
  misc_feature (9825006)..(9825779): n is a, c, g, or t
  misc_feature (9836087)..(9836150): n is a, c, g, or t
  misc_feature (9877326)..(9877350): n is a, c, g, or t
  misc_feature (9884775)..(9884874): n is a, c, g, or t
  misc_feature (9893618)..(9893877): n is a, c, g, or t
  misc_feature (9894717)..(9894731): n is a, c, g, or t
  misc_feature (9917333)..(9917388): n is a, c, g, or t
  misc_feature (9917772)..(9918477): n is a, c, g, or t
  misc_feature (9919120)..(9919228): n is a, c, g, or t
  misc_feature (9928928)..(9928941): n is a, c, g, or t
  misc_feature (9929298)..(9929799): n is a, c, g, or t
  misc_feature (9946081)..(9946165): n is a, c, g, or t
  misc_feature (9946581)..(9946597): n is a, c, g, or t
  misc_feature (9947401)..(9947788): n is a, c, g, or t
  misc_feature (9958851)..(9958901): n is a, c, g, or t
  misc_feature (9967765)..(9973519): n is a, c, g, or t
  misc_feature (9973790)..(9974028): n is a, c, g, or t
  misc_feature (9980907)..(9980944): n is a, c, g, or t
  misc_feature (10026359)..(10026458): n is a, c, g, or t
  misc_feature (10027066)..(10027075): n is a, c, g, or t
  misc_feature (10053388)..(10053397): n is a, c, g, or t
  misc_feature (10097799)..(10097928): n is a, c, g, or t
  misc_feature (10103851)..(10103882): n is a, c, g, or t
  misc_feature (10135097)..(10135106): n is a, c, g, or t
  misc_feature (10135335)..(10135434): n is a, c, g, or t
  misc_feature (10135815)..(10135959): n is a, c, g, or t
  misc_feature (10159072)..(10170681): n is a, c, g, or t
  misc_feature (10238177)..(10239187): n is a, c, g, or t
  misc_feature (10285431)..(10285443): n is a, c, g, or t
  misc_feature (10291557)..(10291625): n is a, c, g, or t
  misc_feature (10413759)..(10415618): n is a, c, g, or t
  misc_feature (10416997)..(10417006): n is a, c, g, or t
  misc_feature (10426773)..(10426787): n is a, c, g, or t
  misc_feature (10429149)..(10429192): n is a, c, g, or t
  misc_feature (10439036)..(10439093): n is a, c, g, or t
  misc_feature (10489671)..(10489721): n is a, c, g, or t
  misc_feature (10501011)..(10501054): n is a, c, g, or t
  misc_feature (10529737)..(10530029): n is a, c, g, or t
  misc_feature (10571948)..(10571957): n is a, c, g, or t
  misc_feature (10582546)..(10582931): n is a, c, g, or t
  misc_feature (10597185)..(10597292): n is a, c, g, or t
  misc_feature (10598066)..(10598246): n is a, c, g, or t
  misc_feature (10598854)..(10598935): n is a, c, g, or t
  misc_feature (10638269)..(10638294): n is a, c, g, or t
  misc_feature (10640015)..(10640114): n is a, c, g, or t
  misc_feature (10747394)..(10748191): n is a, c, g, or t
  misc_feature (10748433)..(10748953): n is a, c, g, or t
  misc_feature (10749266)..(10750425): n is a, c, g, or t
  misc_feature (10751440)..(10763012): n is a, c, g, or t
  misc_feature (10763590)..(10776080): n is a, c, g, or t
  misc_feature (10776305)..(10776896): n is a, c, g, or t
  misc_feature (10777120)..(10778295): n is a, c, g, or t
  misc_feature (10782285)..(10782384): n is a, c, g, or t
  misc_feature (10821861)..(10821930): n is a, c, g, or t
  misc_feature (10852263)..(10852308): n is a, c, g, or t
  misc_feature (10864007)..(10864104): n is a, c, g, or t
  misc_feature (10890818)..(10891956): n is a, c, g, or t
  misc_feature (10921593)..(10927725): n is a, c, g, or t
  misc_feature (10933419)..(10933731): n is a, c, g, or t
  misc_feature (10938154)..(10938163): n is a, c, g, or t
  misc_feature (10938552)..(10938561): n is a, c, g, or t
  misc_feature (10939264)..(10939273): n is a, c, g, or t
  misc_feature (10939630)..(10939639): n is a, c, g, or t
  misc_feature (10941167)..(10941209): n is a, c, g, or t
  misc_feature (10958833)..(10959654): n is a, c, g, or t
  misc_feature (10961672)..(10972136): n is a, c, g, or t
  misc_feature (10973419)..(10973656): n is a, c, g, or t
  misc_feature (10974306)..(10980893): n is a, c, g, or t
  misc_feature (10982885)..(10985369): n is a, c, g, or t
  misc_feature (10986878)..(10989437): n is a, c, g, or t
  misc_feature (10991176)..(10991588): n is a, c, g, or t
  misc_feature (11003127)..(11003155): n is a, c, g, or t
  misc_feature (11060311)..(11060320): n is a, c, g, or t
  misc_feature (11128945)..(11129061): n is a, c, g, or t
  misc_feature (11135443)..(11135509): n is a, c, g, or t
  misc_feature (11153614)..(11153746): n is a, c, g, or t
  misc_feature (11170636)..(11176434): n is a, c, g, or t
  misc_feature (11206821)..(11207195): n is a, c, g, or t
  misc_feature (11226025)..(11226054): n is a, c, g, or t
  misc_feature (11239845)..(11240029): n is a, c, g, or t
  misc_feature (11290546)..(11290618): n is a, c, g, or t
  misc_feature (11305342)..(11305395): n is a, c, g, or t
  misc_feature (11357221)..(11358451): n is a, c, g, or t
  misc_feature (11397504)..(11397513): n is a, c, g, or t
  misc_feature (11397970)..(11397979): n is a, c, g, or t
  misc_feature (11398395)..(11398404): n is a, c, g, or t
  misc_feature (11398867)..(11398876): n is a, c, g, or t
  misc_feature (11399540)..(11400002): n is a, c, g, or t
  misc_feature (11406110)..(11408919): n is a, c, g, or t
  misc_feature (11436727)..(11436891): n is a, c, g, or t
  misc_feature (11450476)..(11450531): n is a, c, g, or t
  misc_feature (11480581)..(11480595): n is a, c, g, or t
  misc_feature (11484495)..(11484636): n is a, c, g, or t
  misc_feature (11490121)..(11490663): n is a, c, g, or t
  misc_feature (11521176)..(11521532): n is a, c, g, or t
  misc_feature (11531757)..(11531766): n is a, c, g, or t
  misc_feature (11532067)..(11532085): n is a, c, g, or t
  misc_feature (11545189)..(11545411): n is a, c, g, or t
  misc_feature (11556271)..(11556358): n is a, c, g, or t
  misc_feature (11611104)..(11614983): n is a, c, g, or t
  misc_feature (11635688)..(11635697): n is a, c, g, or t
  misc_feature (11636582)..(11636678): n is a, c, g, or t
  misc_feature (11659473)..(11659495): n is a, c, g, or t
  misc_feature (11682512)..(11682522): n is a, c, g, or t
  misc_feature (11683185)..(11683390): n is a, c, g, or t
  misc_feature (11691922)..(11692036): n is a, c, g, or t
  misc_feature (11738737)..(11738803): n is a, c, g, or t
  misc_feature (11784794)..(11784815): n is a, c, g, or t
  misc_feature (11787917)..(11788269): n is a, c, g, or t
  misc_feature (11850466)..(11850475): n is a, c, g, or t
  misc_feature (11864577)..(11864586): n is a, c, g, or t
  misc_feature (11907589)..(11907627): n is a, c, g, or t
  misc_feature (11913649)..(11913669): n is a, c, g, or t
  misc_feature (11924239)..(11924248): n is a, c, g, or t
  misc_feature (11924530)..(11924623): n is a, c, g, or t
  misc_feature (11925177)..(11926002): n is a, c, g, or t
  misc_feature (11926579)..(11926588): n is a, c, g, or t
  misc_feature (11938581)..(11938590): n is a, c, g, or t
  misc_feature (11940311)..(11941846): n is a, c, g, or t
  misc_feature (11942271)..(11948571): n is a, c, g, or t
  misc_feature (11949572)..(11949581): n is a, c, g, or t
  misc_feature (11952183)..(11952192): n is a, c, g, or t
  misc_feature (11952741)..(11952794): n is a, c, g, or t
  misc_feature (11953652)..(11953759): n is a, c, g, or t
  misc_feature (11954154)..(11954163): n is a, c, g, or t
  misc_feature (11954566)..(11954575): n is a, c, g, or t
  misc_feature (11955322)..(11955331): n is a, c, g, or t
  misc_feature (11978263)..(11978263): n is a, c, g, or t
cccacaccacacacaccacaccacacaccacaccacacaccacacccacacacccacacaccacacccacacaccacacccacacaccacacccacacccacacaccctaacacaatcctaacagtaccctattctaaccctgatgaacctgtctccaaacctaccctccattaccctacctccccactcgttaccctgtctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatttcgtatcttgtgtcctggattgtttttcctcatgatggtgtggtttttccaaaatatgaggacgactgctttactcgtgaaaatggaacacaagatgcaattcttgtcgactattataaatgagcaagaaagtggtgcgaatggatgggacgaaattgcaaggaaaatgaataggtacttgtttgagaaaaaagcctggaggaatgaagagtttttcttcgacgggattgactgtgaatggttttttagccacttcttctaccgccttctatctgcgaagaaatctatgtggcctttaccattaaatgtggaactatggccatacattaaagaagcgcaattatcccgcggtgaggtgctcttagtgtagaaataaatacaactttttcaatttatatattgtgtagtttgtcaggttcgaataaccaaaaacgaggttactttttactattattttactgtattgattacaatccagcagtttcaaacgaggcttctgttgttaatcagacaatatgttgaaagctttacgaaattctgtattgcaaaccccaacaaacgtaccgccgctattcaaagttccaattacattatgagttttatggtctcattttgccacattgtaaaaatattttttacagtttccactagtaatggattccctctgagacagtgcactgctgttcttgtcacaaatccagctttataataacgtactagaagatatcatgactatagatgtacttcttaaaaatcaatacgtagaaatatttagacaaaccatctgaaagcgtttgtcgagttatgagagctttgttttaaagaatcattgaggcattttatattgaatttgcagtcctaggtagagctattataggaaaatgcgaatccaaaaatttgttcactctagagggtctaagcatggacgcaagatagtgtcgtcgctggaaagtttattgatttcgtgagcacgcctttttaaacatatttttatgatttaaagtgtatctatcctttcctacaatgtccccgcgcctcacttaatccgaaggtattacagtacacttgttatcatacgaaaacttttgaatcttctcatatacctactgaacttactataagaaaaaaattaacttttaaattattgctttaagatacgcgagagagaaacagagttcgagtgtagaaggtcacacttaaaatttgtatgtaatgcaaaaactcttcaattatagtattcaaaaataaactatttcctcactttgcttgctatttattcttggcagatcttgtactcatttcatacactttgaatcttctaatttgtggcattgcccctattataacagcttcgttcacactttggcccaaatatttctattaccagttctgaaaaaagttttatatattatttcacaacattaccagtcacttccatgcgtgccttccctctttgaagaattaaattactggcataaacgaagaatatcataattttacttgtagcttctatccaatttttttttttgtccttcttcatacttttactcctgcttttattactctaaatttcatttttatttattctcttctaccgtgtcaattggacaaaaaattcaagttctgatatctatgcaggtcaccctttatcagaaataaatcttcagtcctccttcttttagtcatatcttagtagctacataacatacacgaaatgcaagaaaaaatgataattgaaggcctccaattttcatatcaggggttatgaaaaagcttgtttttattagtcgtttgcatacttgaattttttttggttcacaccaatttgaaaatttcagtcatcattttagcaaatttatcatgagagtgcttcagtgccacctttttaatacggtggtgattaacacttcgcttttcagtttggagaaaatcaattgtctccgcttttcgtacttctattttcctctttcgcttaataataatcttggcgcacattacgtaatagccaaaccctatttctctcctctttgaactcgaattgaaggagttctttcggaatgaaagaatataaaaatgaagggttacctacttaactttttgttagcggtacctctttcaataaaggaatcttcaaataaaaaaataaaggcataggtctaagactagaaaagatcgcataacgatatggtattggctaaacaatgggttttgaaaaacctatcaacccctggtgaaccatttaactttcattttcacgatcctgcatgtactttcgagctcattgaaaaggaactctcttcagaacaattaaaggacggtgaattactactggaaacaacttatttatctaatgatcctgcccaaaaattttggatatcatcaatggacaaaaattacgccaaaggtgtccagcctggtgaaattattcctgcaagaggaattggtaaagtcttggcctctagaaacaaagcattctctcctggcgattatgtctctgcagtgaccggctggactacacatgccataatttcgcaagaaaatgttcaagggctgagaaagcttgacaaaaacaaagttggtaaattatggtggtatctctctgtcttaggtggtacgtctttaacagcttattttattttctttacttatgctcaattgcaagaaagagaagaggactatggaaaagtttacctaatctccggtgcagctggtgccgtcggtactgtttgcattcagctggccctaaacgtttttaaggcttcaaaggttattgctattgcaggtggaccagaaaaggttgcttttgttgaatcctttggtgataatgtagtcggtgttgattataaagatccaaatttcaagcagaaacttatcgaggccgctggaggtgagaataccgtggattactttatcgataatgttggcagtaatgtgttggaagcaggtgttctacttctaaagcaaagggctatgttgatagcctgtggtgctataagtgcctataatgagccatctaaatttgtctttaaggggtatagctttattctgactaaacgattggtcgttaaaggagtactagtgacagataatattgatgattttccaaaggcattagataaattaagttctctggttaagcatggtaagattgacatcttgaaatccgctacccttgaagatggtaccggtgataagttcaagaatgttccattgatatggaagggtctatttagcggtgttaataaaggtaaacttattaccaaggttaacaatgaggagtgattttacacagaaagtttaagataagactatattatttttattattgtatctacttcgttttggctcttataattttttagtggcctaaattttcaaaggaaaaatttattgaatattttgaatgatatttaaactctatattttgaaatctatacattgaatacatataagataaactgtgttgctcttattgtatatctagcttataggaaataggctctcgtgtctcctcactaacgtaatcagcaacaccgatgaatttattccaaaatttgtataccttcatcaaagataattcccagatgttcctgggtaaatccaaatagcttctataaataaatctgaatgcttctaaaacgttgttaacttcagtattccaagctttcttccatttatttactgtaccgttagagggccttggaactatttctgctttgggcatttttaaatcatcaaatacatgtgattgagaattgttagtctttttctttccttctttagtggaattgatgttctctatggtgtaacgaatcgacttgcctgcctccttcaaaatgttgaagaagttattttggaagaatgagcttaacctgttttcagaaccgtttaaccttttcccgtacattttttcgaacatgttaacagattcaatagattcagataatctaccgaaagtttgtaatagtgcaatcaactcatatttggttaacttaccaacaatatgttgtttggtgaattcatcagcgtcgttgatttcaaacaaaattttcaaggcagttgcgtaaccggtagtttgaattttgccccacaatctacatctatcacattgcacacaatccataatcttcgtgacattcttgaagcgagatctgaattcgtccttcaaagtcaaacttaggtcgttggcaaaaactaagtcttcgttaaaaatttttgtgtccagctgggaaataacgttatccattttgtttttgatttctttattgactagatcacagaatgaaaattctggtaaatatggttgaattttccagagagccttagctacaacagcataattgaaatacatgtttgtcactctatcaggaaagttcccgattcttgccataaacaaatccagattgggctcccatttaccagttttcgtgttcaaatattcctttgataagtgagtaccgatagaggcatggaaaccggatacaagtctataaaatgcatctttggccaatgattcaccagtttcgccaattgtaaaacagttgtcttggtagatagtagaccaaatttgaccagcttgcttaccaccataacctgtaaatcgttccggatttgctgttaaatcaatcagaacggcgtttttaccgttaaagtcatttacatcacagtagttgatggtgtcttcgatatctacaggttttttactggtttgacatagttgatctaagaacttacattcgtcatcgctatcatccgcttccttcattgtatcattattgaaactacccaagatctcaggctgccagtactcaggcagtgtatcccagtcctctacgacatcaacagagcaagcgcggtttaagcacagaccatcgttggcgtcccaaaatgaacattgcttgtataaatccagccgaaagtatttgaagaaatcagattttaataacgccgaaagatcatctctaatgttttcatttatggcatttaattcattgaatgttacgttacaactgggactaacgtgatcattcctgtcgaccttacaaaagtgagtgtcattaaaggcattttgtgtttggtcggtggcgatgtagctattgtttgaagttgcagatgtaaaagccgtgaggcacagtgtggcaatggcggttcttaatctcatgttttacctgcacgttactgtggtatatgcaataaaatgtttacactcttgaaatagtataaccagtttaagtggtaaaccttttcaagctctttatacttagcttcaaggatgattgaacaagtttttatgacacgtactccgtatcgtttcttttttgttctcttcttttctttttgttcttactaacgcccaaagccggaaaaatgcgaaaaatttccagggtcttctataagagaaaccaaaggacaaagggaaaaggacatacttagcaggtagctcaatattatttgtttaattagaacagtcttctctttgtgtatgtcttgtaccattgtctgtggtattctcgatttgtgtagaatacatttgccataaaatgtcagtagaccttttctctgatacgcagtgaatatatcaattctcctacatatcctattgttcattgaaaatatgaaaagtaagcattactcaatagatagataagaaaatgatctcgtttcagttgtgaatatgtttcagaagaaatgtcttgatagtattggtaatgtaggatgggcaaaccatatgtaaggtaggtggttggcaatttactttttttgtgttgccagtatgtatatatgcttttggggggccttaatgtttaccttcaaggtacgatatttagcaagcatttctagttctttatgtggtgaataagtaatgtgtgtgtgaactatggctactggatgactatattcggcattagtatttaataagggtacgactctgaagtatcagagttgcatcatttcagacacactggagggatcctgttatatattttgaaataaataatgtacaattttacgggtgtacacagcacaaaaaggaacgtattcttaccgccgtgttctttccatcacgaaagtgacttcattgcgatgtatttttcagcaagaattaaggtaataagatctcttcacaaagctgactcaaaaggcctacataatggcagtaagaaaaagtaaacagcgagaaatagtcagataaaaaactagatggcgaatagacgacattttagaagaaaagtgtttcagcctttggcctcaaacctcagtggcagtctttcccctgataaggaataggaaggcatgcagcgatatatatgttagttttgcctacgggaatccggcagcaatgttatttatttttgttgtttcttatgatttaattattatatacaggttcgtaaatattggcatgataatgaggagaaggtggaaccagcacactacgtcgatggaggcccttagaatatagtgcaacacttaaaaatgtaatctagtactttttcttcattttattagcactgggttctcgcagtttactcggtaggaggtgcagtaggactttgcagttgttgattgtcttcttcaagtgccttttgttgggtcacttgttgttcgtacttcttaccgttcatgtataaagtgtaagctaagccacccgacatgtataacgtaccaccaaccaacgtcagtaccgttagacgatgtaatgtatctgtaactctggtataccaagcgtatttggacatgactatctgcgttctattttttgttctcttcctctcaccattgccaaaccgctgtatagatttatgctcctttcaatgcatttattctgatcctctccgatttcgtataccgggtaacattaatcgcaaggaaggagaagcaaagctcagaagtaaggaagaacttcgaaatctgcttccgagagtgaggaaatagtgttttctaaagagtgtatttcacagtatgtaacattataaagacaaaatacttacttaagcaaagttatatagaagtgacaacgtgttttttcgttttgctattagcttgtccattttacggtaaaatatacggatgaaaagaaaaattggggagaaaagtacattacgttgacaccccaatcattagttgaaccctaatatgcttttcgaccagtttttaacgttatgtaggtacctcttgtaagcaggctccttaacagtgccgaacaaccattgcgtattctgcttggccaagttgattaagtcgtccttcgtagaagtctgtttaaccggaacaccgaatgattttaggtactgcaataggtcttcttgagaccagctctgaaaggtatttgaccaggtcttagcgatttggtccttagcatcatttgtgtttttggaaaccttgtcaaaatcctgcataattgtggagtaagtctgagaatcttggaagtcgtcctttttgtcagcaaaccaaccctttatgtcatccaaagaccagttactgttgtcaaagtatttttggtagtcttttggcaggatcttgagtttttcgtttctggattttttgactaattctctcaattgatgttcagtagacagcattgagtacttaataccacgagcatctaaaaacattttcaatttgtcctttggccaagagtctaggccaaccaaaaaagtatcattgatcacattgtcagtcttacctctgaacttggagtacaaatttgtgaggaaatttttagaagagtcccaaacggaaccaacgtattctggggtcttggtcaaaaatggagaagactctcttttcatatagtccaggtaccagtagatatcatctttcaaattggcagaattttctttggccattctaaccaaatagtcgtgtttcttggccatgttcttgtcaatattgaccttgtggctctccaaccaattggttaactgatcactagaccacttgtcaaatacagtgtcttttatttgtcccgatgtgtctaatatttgttggtgagccaaatccaagctttctagcaaacccagacgctgctgttctgccttttctgaagttcggtagatgttttccttgactttctgaactagctcgtccttgctttgaactgccttgtcgtagtcgataccattgtcattcaaccagttttgcaaatctttggttgaccagctatcaaagtaagagctagaaggatagtatcccgacgacttcaaagatttggaaatcttgttgaagttctccttagcagtcttcaccagcgagtccttggaagccttagcgtcgtcaacatccacgccgtttttcttcaagaagttacgtagactgtctgtggaccaggtgtcaaagagccagtcagaaactgggtgatccgaagaaccagtataaccaaaccatccggggttactgttgctcacgctactgctgtcactagaccacacctgccaccatggtttgggctgcgcgtgtttgtcccatacctgcgatgcctccgttttcaagtcctcaatggagtctgtagcgtacttttccaagctcttcttattatcacgtaaataatcggccaggtcttcctgcgtccacttgtcgaacactgaatctgaattggccaacactaagccaataagcacaaatgatgcggaaaccgcattaaccaacttgaattgcttcatcttcttctcttaattaacagttcttttgtagttgtctcctcttctattgcagatcctcttctaaactccggtaatctaatcatgctaggaatacgactccatgagtggctttaaataccctgtcgatcccctttcaccgcctccttgtttcctccctctcccttattttccttcagttccaaagatcccttattcttcccctctaaggtgaggccggcgtaatgctgttgcttaccgacgtaatggtggaaaaggtgaaaaaagtgaaaatagtgatattcttagagaaaaacgaaaacaacaagtcgtgtcaagaggtagtgttttgggaaagacgtcatagagaaaggcagaaagcttgtaaagaagtggaaataaagattgaagatgaactcgttagcttcaaacacaccgctaaatggtactccagtaagcgaggcacccgccacaagctccgagcctgtgaacatgttcgagacaatggtggctaaccctattaaagtgtctcgattacagtctaatggagttctgacgggacctgcagccaatactaagtccatccactattcgctggccaattttaatgtgttccagtcgctacccaaggaaacggccagaggtgtagacgatttgacgaggatggagatggcgttactgagtgggataccggaggagattaagtggtctttaaaaaaatatcttacgtatagtaacaaggcgccatatatgatcagcttacggacattgccggacctgttgccacttttcaagactttcatattgcctttggagcgcatcgtggaaggtcttaacaaatcgtctatatgtgattcaaaggcgatggattctctacaaatgggtctaaatgccttgctgatcctaaggaatctggctcaagatactgattcggtgcagatactagtcaaggatcgagaaatcaaatctttcattcttttcattttgaagaagtttcagtgcgtcgctacaggcgataacaagtggcaattgtacgaaggaaatgcaactttttttaacgagttgacccattatactctggacttgatggaggccatttcgtcctatattgctcctgcaatgaaggatgatcattatttccaaacgctggtgtccatcttgaactacactaaggacagatacatggttatttctatattgaggtctctttcaagattactggttaggtccaaagctaacgaggaaagtgcagcggacaatttggaccataagactctttcgttgatcgtttcctttttactgttagaatgcgatagtgagctgattattgcttcgttggatttcctctatcaatacattttgcccggttctcaaagaatcactgagttattcaagagtaaggagtgctctttgatactggaagccacgctgcctaatttattatcatataatatcgccacaccagattaccatcttttgcaaaagcacaaaattaggttgattaaaaggttgaagcctcccgctccaaaggagcctcccaatttatctgaggatctgtttcaacaacttttcaaacttaacgagcccttgaggtcaaccgcttggttgagatgttgctttgagcctgtacaagaagcagaatttacacaaatatcgctttggagatcctacgaatccaaatttggtcagcctgttcgcgaatccggacgcaaattgttacctgccgtggaattcatcaagaatgtctcgaatgctttcaataacgccgctgctatcgtaatcactgacccggtaaccggcaagaaaaggtttgttatcaagggcattcaaccaagatttaaagctttgggtattgcagacggggaaagagaatcccaggtacccatttcggcactaaaatccaaatttttgaatgactctaaggaaattacacctgcaagacaaaacagcataccagaggtcaaattccctcaagaactctcagatgtttctaaagtggcctgtacgtttttgtgccttttatccaacgacacggatgatggtgctggttccgcattttgtcaacgcatcaggccactggttctacataaattggctgatattccacctttaacattagcattgtctgaatacatggaaaacacgtcggggttatgaatgagaaaaaaaatcggttgggcttaactttaaagaaaaaagttgagattagatttattgtgttataaatatagatatacaattctttataaaaaaaatatatatatatatcattgttattaaataaagagttttcctagtatatagattaaaaaactactctattaaatgagagctaaaaaaagcaggctgccaaaaaaataaagcatttatgaagggggttcagcaagatgcaatcgatgggggaagattattttttaacatcgtaagatcttctaaatttgtcatcgatgttggtcaagtagtaaacaccactttgcaaatgctcaatggaaccttgaggtttgaagttcttcttcaaatgggcattttctctcaattcgatggcagcttcgtaatcctttggagtttcggtgattctcttggctaatttgttagtaatatctaattccttgataatatgttggacgtcaccaacaattttgcaagaatatagagatgcagctaaaccggaaccgtaagaaaataaaccaacacgcttgccttgtaagtcgtcagatccaacatagtttaatagagatgcaaaggcggcataaacagatgcggtgtacatgttacctgtgtttgttggaacaatcaaagattgggcaactctctctttgtggaatggcttagcaacattaacaaaagttttttcaatgttcttatcggttaaagattcgtcataatcgcgagtagctaattcggcgtcaacttctgggaacaattgaggattggctctgaaatcgttatatagtaatctaccgtatgattttgtgaccaatttacaggttggaacatggaaaacgttgtagtcgaaatatttcaaaacgttcaaagcatccgaaccagcgggatcgctaaccaaccctttagaaatagccttcttggaataactcttgtaaacttgatcaagagccttgacgtaacaagttaatgaaaaatgaccatcgacgtaaggatattcgctggtgaaatctggcttgtaaaaatcgtaggcgtgttccatgtaagaagctcttacagagtcaaatacaattggagcatcaggaccgatccacatagcaacagtaccggcaccaccggttggtcttgcggcacccttatcgtagatggcaatatcaccgcaaactacaatggcgtctctaccatcccatgcgttagattcaatccagttcaaagagttgaacaacgcgttggtaccaccgtaacaggcattaagcgtgtcaataccttcgacgtcagtgttttcaccaaacaattgcatcaagacagacttgacagacttggacttgtcaatcagagtttcagtaccgacttctaatctaccaattttgttggtgtcgatgttgtaactcttgatcaacttagacaaaacagttagggacatcgagtagatatcttctctgtcattgacaaaagacatgttggtttggcccagaccaattgtgtatttaccttgagaaacgccatcaaatttctctagctcagattggttgacacattgagttgggatgtaaatttggatacctttaataccgacattttgaggtctggttttttgttcagcggtcttttgtttttttagttcagtcatttgcaagtttgtattgtgtaattgttgttgcttttgcggcctaagtcttcctttaataccacaccaacaaagtttagttgagagtttcatgctgcaccttttatagtaatttggctacgaaaattggcgaggcacccaaacagttccgcccgatgaggccgaatggagcctactttcaacacactcgtataattaatagcccggttcattttcgacacgataccgcagccatggagattgtgggtatgattactctatagtattatgtaatattgtatggaaaatttttctattgtatatacgaagcttattccgttaaaagacgaagacttgatcgtcgccagaacttctcgttgaattgaccttccagcccagttctttagcgtattgaagggccaagttgttcattccatcaggtccacagatcaagagtctgttatcctccgaatattccggcagatacctgttcatctggtccttggtgatgtagccgacatctccggtccatctgtcggatggatagtgtaccacgtaatggacctggaaatgtgggtatttttcggccatctcatccagttcgtccttcaatagaatgtcattttcagtctcattggcatatagcagggagactttcgtcaaatcttcaggaacggtgatgatttcattcaagatctgtaggactggcgtgataccagaaccaccggctacgatacctaaatgcttggaggaatttggttcgtagttcaaagtacctattggccccttgaaatccacggtgtcaccagaatttaagccagcgaaatatttggagactttaccatcaacgtatgctttcaccaccaaatccaagtatccactttctagtttagaactgatcggattatagtatctgacctcttgtttgccgtcaattggaacgcgtacagcaacatgatgaccagcgggaatgtccaagctttccagtcttgtcttcaacttaaaacgatacagggcggtattcttggaaattatggtttgatcttccaattctaacgaagtccacctatctggatacagtgatcttcttcttttgtaggcagagtatgctctgacgaagatgatcatgaagagaatgggtaaactccacaggattttcaattcaccagacatatacgtggtgattgcaacaccaacaacgaatagcgcggcaggaatatagatcccgtggacaggttcgtctagaatgttagttccttctatgtcttcttttgacattttcttcacgcggttcttggagtgcttccttttttgtgataagtttgggtggcaacgagatgagctcaaaactctttgttttttatgggtatttttgtcttagaatattttcaaatttttcaatattccgcggaacatagggaaaaaaataaatttaataagctattgttctaactgtacacctaaaggtaagtgaaaaataattcgataattagaggtatctttatttggatagaatatgcatatatatatataagcgtatatatatatatatatatatgtatatacatatggacattaagtaaatataaatctataagtgggtatcgggatcagagccactttcttagaactcctcagcgtaagaatcggcacccacttcaatataatctctttctaaggcagctaaatcttctctagcttcggtgaactcaccttcttccataccttcaccgacataccaatggacgaaagcacgtttggcatacatcaggtcgaatttctgatcgattctcttccaagcgtccgcgatggcagtggtgttggatagcatgcagacagctctatccacattggctaattcggaacttggtatcacacttggtggctcataacaaataccaatcttaaatcctgttggacaccaatccaccatttgtactgtttttttattcttcacctgttcgacggctctttggacatctctggtcaccacgtcacctctgtataacaaacagttagccatgtacttcccctttgttgggtcacacttaaccatttgattgcccggttcgaaacaagcgtttgtgatttctgacacggagttggattcatgggtggccctcttcttggacaagatgggtgcgtaggaaaccaaagggaaatgaattcttggatatggtaccaagttggtctgaaattcgttcaaatccacgtttaatgaaccatcgaacctcaaagaggctgtaacagatgatatcacttgggcaatcaacccgttcaagttgctgaagcttggtctagaaattcccaagttcctcttgcatatatcgtaaatggcttcgttatcgaccataaacgtacagtctgcgtgttccagggtggtatgcgtggttaaaaccgtgttgtaaggttccacgacggaagtagacaattgaggcgcaggataaacggcgaattccaatttggatttcttcccgtattcatacgataagttttctaataacagggaacctaaaccggaaccagttccaccaccgagggagtgggtgaacaagaacccttgtaaaccgtcacattggtcggccatctttctaattctttcttcaacttcatccactatttctctacccactgtataatggcctcttgcgtagttattggcggcatcttccttaccgttaatcaattgttctggatggaaaagctccttgaaacgtcctgtacgtacttcatcgataacattgggctctaaatccacgtagattgctcttgggacgaattttccgtaccccgtttcatggaagaatgtagaaaatccttcttcacctcccttaggttttgacaagccatcctccaaatggccgtcttccttgatgccatgctctagggagtacaattcccagcatgcattacctatttgacaacctgcttgaccaactgttgtaaaaaagaaaaataacaaaagttccagcaatcctccgaagaagaagacacaaaaatcactccccatgtaatgaggtcaattatgagctttttcgtccgagtatgcccagaaaaaatggagaaaaagaaactgttagtaaactgtgctggtacaagtcaaattatttgccgtaaatcaaccagatggtgaccaattgggaatgaatcaaaccagatcagatcaaacttctttccctgtcccacaggtgccattggttgcgaatattgaacaaaaaaaggaacgcatacataccattaatactaatgacctctctcattgtctcaagtcgcttgcttagtcgattaatgtactttatgagatacctgatctgtgtttatatttcttttagatgtgcaatttgtaaaacgtttcgtggtttccagaggctcgagaaatgatatgtcgggtaacgtctggaactaaaaaagaaaggacgatatgctctgctctggcaccagccaacaggatggcagagagatgtgaggaaataatgaaattaaaagaaattatcgaataaatatgtaacctgacagtatttatagattatgtaaggggtttgataataagtttataaaaatgtttttgtattatttgttctagtttacaagttttagtgcatctttgaggcttttatgcttcatgttgaagttgagatgggctggaagattcaatgtcattattcttgtttctgaagtttagcgtagcaggatcgatttcatcgtggtatagctcgttaatttcttctagagtctttctcttagtttctgggatcaacaaggttgtgaagatacccaacaacatgaataaggcgaaaatttccatgacgtgaggtaaccaacagttggttggcttaccgtctctagcacagttatggtcgattagagtacccaaagcggtttgtgcaataatggcaccgaccttaccagatgcagcagaaataccatgagcagtagatctgtaacgagttgggaaacactcaccaggaacaataaaggtggttgtgtttggaccgaagttttggaagaattgacaaatgacgtaaagagccaacagaccatggtcaccaagtttatggtatgcgaaaccgatgacacagaacaaagcggtcaagatgatgaaaccggctaattgaattggttttctaccgattatatcgacagtgaagacggatacccagtaaccaggtaatgaaccagcacaaatcaaaatcagattaccgacagcagtatcatacagtttcttgtaaacgtttttggaaccggcataaccgatggtttgcagaataacagcactgtttaaactcaacccgtagaaagcaacatctaaggtaaaccatgaaccagcagtacctagcaaaatcttaccgtacttccattgaccaaaatgtctgcagaaatctttgaacgaagcctttggaggatgattgtcaagagattcgacggcagtagaagctctttccaaaccgttaattgccatgtcttcatcactggtgtcgtgaattttcttttcgccatcttgttcttgtgcggcagcagcaagttccaacttagcgttaacatccaattgatatctaggagattctggaatagttaatctgaaatacaaacatgccaaccctagaacggtacccaacccaataaggattctccacatttggtcacaagccttttgacatctagcatcacattcagcaccagagtttgcgtattctagttcgcccttgtaagcagcaaccaagataagagcgatgataccaccggagatttgaccccaagcttggttagcaaagacagcacccatgatggcacctctccatttggtagtggcaaattcagaagtaataatagaagatagtgggtagtcaccaccgataccaatacccatgacaatacggtagaatgttaaaacagcaacgaagttaatagcaggagaatgagcaacagtggtttgcagaatggtacagacaatcatgataataagttccataccataaattctcttacgaccaacaatatcagctaaagtaccaaaaccaaattgaccaataacagtaccaacagaagtggaaaccttcaacaaggtttgacttggacctggcatactaccgtgccagtaaacgtaggacatcatagtgatacccaaattaatggcaaaaatatcataagaatctgtcaagaaaccaacaccagcaatggagatggtcttaacttgttgccaaccgaaaccttcgtcatcgatggactccaaagccaatcttcttctttccagaggatcttcaatatgagcaaaatcattcaaatggttgtggaaggccatgttaccaccttcggtaaggtgttctttatgaagacttctttcagcaacatgaatagtatctttattgacggaactcatttggattgtattcgtggagttttgtttgttgtgtgccctggtgatctacgagatgaggaaagataaaatttagaagtgaacttagaactttactttatacaagagatgaggatgagcttatatatatacgtatacgagccacaatagtaagtggatctaagttggcattaccggtgtgcaatgtggttgcatcatgctgccaaaaaggaataataattagctcatagatgaggtcggttaattaatgagtaatacgcacgtttttaatctagctaataagcaggcaaaacgggagaagagggataaggaaagcctttcacacgacatttggtgcataactgcaccgatctcactgatttcgatggactgcggcgaaccataatcaattgccgtcgctaatttccgccccacgtgctggaaataacacgtccacgtggaactattaaattggcatcgggcggtgcggcagtgagaggaacgggtgtttttcagccgggcaacattttcttcatagccgctagatgagttgaaagggcccttacgagcaaatgctgcacgtatagggcgcctataacagcaccaacgtgcgtaatactgattgctgtcatttcttggcatgttttcttggtcaaggtctgtgatctccccttccggttgtgtcttttcataataatatggtttttttattcataatttggtaataacggttgataaacgagcggctgataaattagttttctttttttttttaattttttttttttgtatctcatttctttttttattgaatcttttttttttgtaagaaaattaaggtttattaggcagagtataccgagtcgtttgaagtcatctccgggtagtgatttttatcacgtgacacttttttattccttttctcttttctttttttaaatttttttttttttttcattgattaaccgcctcttctttatcactctcgcattctgtctactaaacggtaaaaaaacgaagtgaaaagttcaatgtgggaccctaccctaaattgtgattatggtaataatttctttttgaataaatacaataggtatcttacacaggagtgaaggccatcaaaatcacgtttatcaatcgacaatttagtaatgtcgtcaaataataggaagaaactgcttctgatgggccggtccggctccggtaaatcgtcaatgaggtcgatcatctttagtaactactccgcttttgacactaggagattgggtgccaccattgatgtagagcactcccatttgagatttcttgggaatatgactctaaatctgtgggactgtggtgggcaggacgtgtttatggagaattatttcaccaagcaaaaagaccacattttccagatggtgcaggtgttaattcacgtttttgatgtagagtcaactgaagttctcaaggatattgaaatatttgcaaaagctttgaagcaattaaggaagtactctcccgacgccaaaatttttgttcttctgcataagatggatcttgttcagttggataagagagaggagctgttccaaatcatgatgaaaaacctgagtgaaacgtcttcggaatttgggtttcccaatctgataggttttcctacttcgatttgggatgagagtttatacaaggcatggtcgcagattgtatgctcgctaatacccaatatgtccaaccatcaaagtaatttgaagaagtttaaggagattatgaacgcccttgaaattattcttttcgaaagaacaactttcttagtgatatgctccagtaatggcgaaaatagtaatgaaaatcatgatagttcggataataataatgtcttgctagacccgaagcgattcgaaaagatatccaatataatgaaaaacttcaagcagagttgcacgaaattgaagagcggattcaagactttaatattgaacaacaacatctacgtcagcgagttatcgtccaatatggtgtgttttatagtgttgaaagatatgaatattccacaagaattagtattggaaaacatcaaaaaagccaaagagtttttccaatgactgaggtgagtagacgaaacattcggcaattgagtgtttgcggggcataagaattataaagctttcgttacgtatatacaaatgggatttggcgtataaaataaatagagaaacataagaggaagaaataaataatcacagatatatatataggacaatgggaggaaaaagctgaagtgatcaaccaatcttgtcggggttttttgcttgtgcattagtcaagcatcatttcgaaaaaagtgggaatatataaataataaaacatcatgtgcatttttttgtgcgtgtgtgtgtgtgttaggttttgtttagagggttttagaaaaaaaaggatgcaaactcaggaaaaaacggtgcctaccaccttttttcctttttccagaaaagggcatgttaatttcatctataatcctttaaaaaagtctcttttgaaaaatgctaatttaatccagtcgaaaaagacctttaatctcgatcttgcagatagaatcatggacaagtacaaaattctccataagtagaaggtcattaagccaccaccggtgtaaaatgttctcttaccggaacgtatggttgcaatggccctttcggatcccaggtatgctaaggcacctaaatcgttgtatttgaaaggtttaaagttgttctcctcgaacaagagatcaattttatcctttcttgaagatagattcttttggaaatttggtatttgagccattttatcaaaattcttggccaaatattcggcctcttggtgcgctacttgggcggttggtggcaacccagcaaatgcattgtcaccaatggcgaaaatgttgttgctgcctttcacctgcaaaaagtcattcactgccaatcctctcttggacgagttttgctcaggaattttcttgaaaaggtcagtgattaccggtcttgccttgttacccgtggcccaaatcaaagtaccgtatggaatagtttcttcggttattttaccgtcttcgtgtttggtctttgccaacaattgcttttcttcaactttggcgacagccgttctcagatgtactttgatcgaagtgttttctaaatgtgattgcgcgtatgatgaaagctttttctcaaacatattcaaaacgatgggcagagcttcgaccaagtgaatttggacttcttcggccaatgcagggagaaactttctcaggtcctggtgaacataatcctgtagttcaccagcggcctctacaccagtaggcccaccaccaaccacgacaatggacagtagtcttcttctttcgggatcaccctttggcaataagttagccttctctagattggcggcaaaagttcttcttatttccaaagagttgggaatttccttcaggaaatgaccgtaatcagtgaccccaggaataccaaatgtgttaggttccgcacctacagcactgattaaataatcgtacttaatttcagcaggttctgcttgatgcagccctagatggttttcaggttggtatagctggctaacggcagataatgattttatggtaacggtattcctgtcgggattgatagaggtggcttctgcctcatagtaggtaacgttcccctttttcttgagagcaaaattaacgatgggctcaataattgacttttcgtctactgtcccaactggtgcagaaggtaacaaaggcgtaaataagaaatagcttctaggagagatgatggaaacgttgtacttcttggtgtcaatgtgctttaaaaacgaaatagctccccaccccgaacccagtatcagcacgtttggtttgtcgctgtgctgagggtcaatgactttcatggtcttaaaagatgtaggacctgctccggagttttccacccctgtggatctggtggaagcgaatctgactagcgtattcgtcgaggtgagcaacctcttgttactatacaaattcttcgatagcatagtggtttttagtttcttctcttgggtaaacgtgtaattcgatgatgtgatgaaactgacaccctacctgaaactcctcaattggtagttaaaactccttccccactatgccctatacatcttatatataccctgtcgacgttgcaaataccggcaataaccaagagcgctaagggggagcactcttattgtggttacccggacgttcaatgccttcatatgattggtccgaatgaataggtcatgagaaaatgcatatttttgaggcatttcagcaatgatcggcaatctgcacatattcgtattgtttccctgagtaagttatttgcggaaagagacattctattgctttggagtattttgtggtcttcgacaataaagcgaaggaataataggttcgttgctagcgacaagcaacacatagttgtagtgatgctatagcaaagaaaggtcacagattcattattgaccttttaaatggtgcccagtggcaattgccgttttagcattctttaaatgcgtagtatatgagttttaaagtgctttgttgttcacgtgcttttcacgtgtatgattacttaaccgggtagcgccggtctttaatatgctttccagattaggaaagaacataaataaaaacacaaaataagaaagtgtcaatcatccgcattgaaagaaagaaaagatttttttatccctcaattgtacatgaaaacagagacctttcaaaacgtattttaacattcttttactcttttcttgcacctgcagccttaggtcagtaagaaaaaaagtaggtagcaatgagcccaagtccatcagtgtcgccaagaaggacgctcaataacaaatcatcttacatcaataacagcggtgggctggtcctgcctcctacgcagtttaatttgaatcagcagccagtcctgagcttccaacaaaaagcgactttcgattccaaccagcagtttttctattatccagagtcacccacaaaaaacctgagaccaaggtttaacagtatttcgcaggttaataaaggagttaatgaagaccattataccgggggcggtagcagtaataataacaggccatctagatatacaaataccatgggcgctgcaaacaccaatgtaaattcccatccgcatcatcagtcggtgtcgcatttaaattctaaatctcttaaattcaatcaaacgaaggaagtgagcagcataaatgaaattatttttccttccagaacgtgtacaaagaaacggtattttaccaagccaattgatttgtatggtacaagaagtagcactagtgtggcacctaagttgacgaattctcccacgaaatcaaaaacaaatttcaacatcaagaagtgcatcttacctaggtccgtcgttaccacatataaattaccatctccagtgcacgaaacgatagacgatatatccaaaaaaatcataatcctgctaatttcgttgaagtttgagaaaaactatcacttcttgcaacctattcaattgtccacaaatagtaagacacggatctcaaaatcactagacgaattatgcggagtgcagctgacatcaacgttacggcaacaaaagcagctgcaaggtaacagcaagcccgtaaagaatctccctaattccaatgcgaagcagagagccggggccagtgtttccacaaatgccaacgaaagctttgaattgagttttgatggaaaggcaatggatagatctgatatatttcgaatggtagattcttttagcatcgccatttcagatgaagatgaggaagatgaggaggaggatagctttcagcagagaagtgcgaacaacagaatcctccctgcggagatactaagtaatgaacctttgaaatgatacggattctctgtattctgtctatagtatttatataccaatacatttttccgcactttgaagttttgcattttacttaatgtagtttattattagttgccaaaacgaaacatttaacatgtgaattaaaaatacaaaaaaaagcctattaacgatctaaatttatgacaaaagacatataattattttaatgatgcctttgtcacaaccgaacacaatatctttgaaaagtgatccagcaatcgaattcagaattcgttgtgccatttttgccttacgtttgcgccattgtaatttctctgtgccgtcttctcttcactttatttcaatattatcatgcagtaaacaagttgcagaataataaataatatacgtaccaaatatgtgaacaactcagatactattcatttgatatgttaaaagtcctgcattcctctcccgacattatatataaaatgctcagccaccccttcgttgcacagaaaaaaaggatgacctataataccaatattcaatcacaatagttataccaaactaacacatggttgaagcagactacttactatcgtggagttagctcactgaaaatttaatatttacagcattaaacagttttttcttttgttttgtctcctacattaatttcaatatggatagccaagtagaaggcaaaatatccccctcacagaaggagtcctcctccacctcaggcctcgtttcacctagtgaagatggcccagcacatcaaaaaatacacagagaccaattaagtgtggatcaaatcaagaaaatcagagaagaacgtgctcagaagagacaggtacgtaggaactctctaatatcccaagggaaggaccctgacttcccaacgcctgacttacaattcattgaaagaccattcctccctatcaaccatgataattcgaaaggtcttacgccagcgaccatacaagtcacccaagattcattggacgttaaaataatgacctataatactctagcacaaaccttgattaggagagattttttcccagaaagtggaccagcgttaaagtggcataagagatcaaaagttttggtccacgaattgaaaaagtacaggcctgatgtagtatcgttgcaggaggtcgattacaatgaactcaacttctggcaggagaatttccataagttagggtttgatgtgattttcaaaaggcatgaagggaaaactcatggactactagttgcatggaacaataaaaaattccagttagataatgattggatgctggactacgataatatattggcgggaaatgtcatttcagcaagaacaagaactaaaaatattgcccttattatatcgctatatttcaagggtataacagattcatcatcaagaggaattatcgtcgcaaatacacacctattttggcatccctttggggtatttgaaagattaaggcaatcttacttggttttacaaaagatccaggaaattaaagcatgttccaaatataatggctggcatagcctactgatgggtgatttcaataccgaacctgaagagccaccgtacttggccataacgaaaagaccactgatattaaaaggcccaataagagctatggtggaatgctcactagcgtatcggtattcaaaaaaaaggaatggagaagaaagtgaccaggatgatgaagagtgtgatgaaaagtctaggggcgaaggccattcagatcaaccacaaaacccaaaaccagagagctttacagccacaaaggaagaaaaggctctggtaaatcaattagttgcgttgcataattcactacatgtgaaaggcgtatctttgtatgggattggctacggtaaagtgcatcctgaaaatgctaacggaagccacggcgaaccgggactctcaaactgggccaatacatggtgtggattattagactacatattttatatcgagggtgatcataatcaggacacgcgtcagaaagagcctctgaatgcttttgaaggaaataacaacgtaaaaataatcggatatctgaggatgccgtgcgcacaagaaatgcccaaacactcccaacctttcgagggagaatatgctagtgatcacatttccctaatgtgccaaatacgcttgttttttgggggggagaaagtgcatagcttaaaataaagaaacaatatatataaacaacctacatttgtgtttgaaagacagtaatcaacgcttcgatggtcactgggatttttctttcaatttagcgtcactttcaccttattcacagcttttacgtgctatttttggtcacccttcccctttcgttgcgcctcaacgggctaaaaaaaaaaaaataaaatcaagcatagaaacaccacaacaaacctgccctttttccttgtttcaggttacgtgaaaagcatccagagaagatatcccaaagactgaagaggtgtagttggctcattcacgtcgttcgtttatattatcaaggaaggggtttttgatcggctcgaacaagactcgcaagaatccgttttctattgttttttttgaggattccaatatgtcaaattccaattcaaaaaaacctgttgcgaattacgcataccgtcaacagcaagattataatgggatgaacgccatggtgggaaatccaatgatgtatcatcctgttgatttcgtaaacggtgccggccaatatggtccttctcaacacccagcatattacaccaactcaccattacctaatattccaccaacaccttttgatactgcatacggtgccagtcttttgccatctcacctattgatgggatctccatttgtttcctcgcctaacatgcaaagtggctataattctgcaagatcatctaatctcaaaagaaaggcttattcgaggcccgtttctaatcataacggttacaacggaaacagtaacagtaaccaaaacaatactaataacggaatggtaacaccctcgaactattatagaatggggagaaattctttctcgaggaacaacaacagtacgaggaatgttactcacaacaacaataaggggtgcgacacccggaacaacagtggaagaagaacattcgcaaggaataacattttcgacgacatacttccagaaatgcttttacaaagacccttttgtattaattacaaggttctaccgactggtgatgatgcttatagaactaggtcgctgcttattgaaaatgtggatcattctattgatttacactctatagtcaaaaattttgtcaaatccaatactctggaaagtgcctacttaattgaaggagggaagagcgatgattcaaaagatgtagagactaaaaatctatccattctaataagctttctaaccaaaggcgactgtttgaacttttacaataacattttacaaaggttatctgaattcaaaacatttttgaaatctgaagcactaaatctgaaatttgtttgtctaaactatgatcccaaatgcctccctacctttattgagagtgaagcgttaacagaaaacgctgaagaagccgacattaccaatggttcaacaatgatcagtgcttcgctgcatcataatatagcgaacaaagatgctacaaggtcgattataattgaattcaaaagccccgtggagaaaagcgatttattcaaaaagaaattacaatttttggacaggtcaaaaaacaaaagatacattttggaatctatcgatttagtgaacacagatgtaccttccaatcaatttcctgaaaattacgccgttttaacctttttgaatatctctatggctattgaagttctcgattatttgaaaaaatactccaaaaacttaggcatttctaaatgtttttacgtatccctagccccgttggtagttagctcagccagatcttcggttgctaatatttacgagggtaaaacgagcacacatcgtttatcggtgccttctgttactgctgggaacaataacgatagcaacaacaacggaaacaataataaaagtaatatgagtggtatcaccacactcaataataatagtagtattggtgtttccgtatacggtcactctaatatgagtttaaccagtctgtcatcatctgtatctttaaatgaagagattgatatgcttgcgacgaaacttcaaggggtagaacttgatgggacttatttagaaatcaactatcgcgactatcaaacaccaactattgaagaacactctactcacttgagcaatgtcaaaatttcaaagacaacagaaaactctaggcaattttctcaagatatcccatcacctttgccattaaatgaacatatgtttatgaatgattctaatcagtccaatggagcgataatacctcaacagttaatagccacaccttctccggtatcccccaatttgcaaatgaatcaaagggtgttgccgaatccaataactcaaagtttggagcaaaatttcaacgtttcggccaaagtggcatcatccatgggttcagacataggcaatagaacaatttatataggaaacattaatccaagatcaaaggcggaggatatctgtaatgtcgtgcgtggaggaatccttcagagcattaagtacataccggagaagaagatatgctttgttactttcatcgaagctccatccgctgtacagttctatgcaaattcatttattgatccaatagtgttacatgggaatatgttgagagttggatgggggcattattctggtccattaccgaaatcaatctcgttggctgttacgatcggggcaagtaggaatgtctacgtaagcctaccagagtttgcatttaaggaaaagtttattcacgaccctcagtacaaaaaattgcatgaaacactatctttaccagatgcggaacaactaagagaggactttagtacctatggtgatattgagcagattaactatttgagtgatagccattgctgttggataaatttcatgaatatatcttctgcgattagtcttgttgaagaaatgaataaggaatccacagtacaaaatgaatccggtgaagtgacgcttaaaagggcgactgaggaaaaattcggtggccgttataagggccttctgataaactacggcaaagatcgttgtggcaatataaacaaaaatttgatagcaggtaaaaattcaagattctataagaaagttaaaagaccgagctataatatacgtttgagtaagttggaagaaaagaggaggcagaatgaaatcgatgaaaaggaaaaggcttttgataaacccttgaacttggaatccctaggaattagtctggacgcacataaggacaacggcggtggtgaaacaggaactgcaaataatactgggcatgaaaatgaaagtgaactagaggctgaaaatgaaaacggtaatgagactggaagtttcggtggactgggtctcgctgtggcgagctctgacgtcaaacgtgcgacatcggatgaaactgattatgaagatatatttaacaagtcatcgggatcttccgactcgtcatcagacgtcgaggtcattatgcactccccgagcgatcctgaatacgctttaaaatcacaaactctaagaagctcgagtcagaccgtcattaatagtaagagaccagtaaagatagaagacgaggaagaagccgtaggaatgtcacagctcaattataggtcgtcattaagacaagctcctccaagagctccctcaactttgtcatataatcactcgaagaacaacgaaacgccaatgcaagatattttcacaaatggcgaaacagcaaataacagaaagaagaagagaggatcttttgcaaggcatagaacgataccaggatctgacgtcatggcccaataccttgcacaagtgcaacattcgacatttatgtatgcagccaatattttgggcgcctctgcggaagacaacacgcatcctgacgagtagtatagctgtgctgagcctgaagtataatgcatatccatcggactatttagacaaagcccaaggaagcctaaggcggcctgccaaggtgtttctccctttttttctccgatttctttgtataaactaaataatatagtgattactaatggaatggcggtattatgcacctaacctgttcattctgccacagattacgtaagcgatttattgccggcacttgttgtcttaatgaccgagtcaccaatgtggaacgataattttctctgactcaaacctgttaatttttttctacttcgtttcgttagcgacgacgtcaagccgcaggatcctgtctgccttgacctcttctctaccttcagaacttacacttttcaggtaagatgaccattatataaaagttgacactattacagttgtttataaacgtctgaagaatgagacgtttttataaaatgaataaaatgcatattctaagtttaaaacaacattttcaaagtgcacgattgtaaaaagagaggcaattagagaatctcaaacaggtaataataatgggcaatcagtcattagttgtgcttacggaaagtaagggtgagtatgagaatgagacagaactacctgttaaaaaatcgtcacgagataataatatcggagaatctttaacagcaacagcttttacgcagtctgaagatgaaatggtagatagcaatcagaaatggcagaaccctaactattttaaatatgcatggcaagaatatctttttatattcacatgcatgataagtcagcttctaaatcaagcaggcactacacagactctttcgatcatgaatattctttcggacagttttggctcagaaggaaactcaaagtcatggctgatggcatcttttccgctagtttcaggctcatttattttgattagtggcagactaggtgacatatacggattaaaaaaaatgttgttagtaggatatgttctggttattatatggtctttgatttgtgggattaccaagtattctggtagcgatactttttttattattagtagagccttccaagggctagggattgcatttgttttacctaatgtgctgggaataattggtaatatatatgtaggtggtacttttcgtaaaaacatcgtgattagttttgttggtgcgatggcccctattggagcaactttaggttgtctttttgcaggactgatcggtaccgaggacccaaaacaatggccatgggcattctacgcgtatagcatagccgctttcattaattttgtgctctccatatatgccattccgagtactataccaacaaatattcatcatttttctatggattggattggttctgttttgggcgtgataggtctcattttattaaattttgtgtggaaccaagctcctatatcgggttggaaccaggcttacatcatcgtaattttaatcatttctgtgatttttcttgtcgttttcatcatttatgagattcgatttgccaagactccactattgccgcgcgcagttataaaggatcgtcatatgattcaaattatgctggctttattctttggatggggctcttttggcatctttacgttttattatttccaatttcaattaaatataaggcagtacacggcattatgggctggtggaacttactttatgtttttaatttggggtattattgccgccttactggtaggatttactatcaagaatgtgtctccatcagtgtttttgttcttttctatggtagcattcaatgtgggctcaataatggcaagtgttacaccggttcacgagacatactttcgtactcagttaggaacgatgataattttaagttttgggatggatctttcatttcctgcttcttccattatctttagtgataatttaccgatggagtaccaaggcatggctgggtcattggtgaatactgttgtcaattactccatgtccttgtgtctcggtatgggtgccacagtagagacacaggtcaattcagacggaaagcatcttttgaaaggctatagaggtgctcagtaccttgggataggattggcaagtttagcatgcatgattagcgggctttacatggtcgaaagcttcataaaaggccgcagggcaagagctgctgcagaatacgattgcactgtggcttagcggaaagcggttattaaggtaaatagatagaaatacaccgctgtcatgcgattatatagacatggggcatttagacactgaaagtcttcatatctcaacatgcaactagtaatagtacaatttttagtaccctttaatctttattgttcgctccctaataacgaagccttgaactgtaaccagatcccaggttaccccttatccttaagaggtcttttatttactctacataatatatatttttcaatccattgaagaggattaaaagaagaaaaatcaataccgaacaaaaaaacaaaacgaaataaaacaaaacaaaaaattaaattaaattaaattaatattaaatgtcatcatgattcttactctgattgtcttctcttctctctttcccttgacgcaatttccttcaaatcgtcatcgctcggttcataaatatgccaaatagtataatgcggtaaaccaccaaccctgtaccccattttctttgccattttaccaaatgcttctgtttctgcatgattttcaaaagtaaatgcaggaaactgtaccccgtttctaaatattttggccttcgccaaaatagaaactccccctacaccgtccaagtccaccgcttcatttggatcaccttctgcatctctgatataggctaagtgaactctccacgtaggatattctgcatagccttctacaataacatcatcttcgtcaagagtctttgccaatgctagtgcctcctgagattccatccaagaattcaaatcatatggttgttcagttcccaaaaatgtaggtagtggtctccaaacgttagggacgataacatcgtagtttttgctcatcaaatcttgaatgactgaaccagggcacagctctacatcagcatctctccaataaacccatgagtggtaaggtttcaaagcattggcagttaaccaatttcttgccctccccattagttttcgtcttataccttgaaccttaacggcatgtctgtcactaaaaccttgtccaattacttggccaaaatccttttggaaaatttgtactgatctaaatggcttgtcataattttcatggaatggtggtgaaaatgcctggtggacacggttgatataaccttcgtccatatatttaagatataatttatcggtgccttttgtttgcgaatcaatgacagcgtcaatctcttgaaaaatctgagacaacgtgccattttgtaagtgcctagaatacgctattaaagcatccaacgtagtgtcaccttctgagcaatcactgactaaaaaggccagatcaatcagctcgtgtggataggttaggttcattaaatgcttgaacattaatggcaatacatccgcagcgtttcttagtggaatgcataaaagaatgtgatcacgtgtttccaatccattcggagcaccttcaaaattcgacaggtcgtactcctcaacagtggaatcaaaaagcatgttgagttccctttggtatttttcatcatccttgggagtcaacacttctgaaccaaattgtgatattagataatgttgcacaccatcatcaaattttgaaatcacttcaggatcgatatcctcaaaatcatagtcgtaatattcttcatcttctaggtcgatagtcttgtaattttcggaggattttgaggaacccaacaacgacctaccattttgcgtggatacaccaatgcccattccggagagaaatgatataaagagatataacgacagaacggcgataataataagagatgtgatactcaccgtaagctggaatttagacggtgtggagcgcggctggtacctgtatttgccctttaatgagttggagttatgctctgagcgtttgtccttgatgttgttcgagctaccgttccttgaaatgggcaggcttagtccattgtccatggctttcttctttatatttgaccttaaattaaaaaacatgcccatttttttgtgttaattggtaggtcaacaagctcaaatgactgttactgcacccttacgtctacttctttcacgttaccatttactaatttacaagacgtaaactttctttgattctaaatatttcaagccttgtttcggtatagtcgccgaagaacgaaaaaaaaaaaaaaaaaaaattcctctccggagataaattgaatacgtattattatattagggacaaacactggttcactgaaagcagttgtttacatagttatatcgtgatctgtggctatatctgcaggaggagatgtcggggcgttttcattaggcgtcgaatgaggagagtgacttgtagtagcatcgatattggttgtgttatgtgctacaggtgtagtatttgtagtatcttgcgctgtcattgttggcggttccgattccgcgaccaggttctccgcaggcatactcgacatttcattctcatcttcactgctccctaagatgccaaataagtttatgtcatcgtcctcatcctcggcgtttgtgttgataactatggtagagttgtttaatgcattaggggtggtcgtgtcgtctgcagcgtcccttgcgtgctcgttatttagtagaagctcaagatcatggccttcatcttgttccctctttgttcgttgtgaaataagctcttcttgccgacgttttagcgattttgctctttcttccttggccattcgtattttttccttcttcaacttctggaccttaggtaaattgtgcatgaatagtgtcatagacttacgaaattgcaattctatggttttttgtatggttttgtgagactggtgaggactctctggaaggtagagagtttcagaaattttcaagaatggattttttgttcttttcaactgattcacttcaaatttcgtgacacgttctctcgccaattccactctatacttcgcatactgctcgatattgttttcattgaaggacttttcagttatggttggtttcctttcttccagcgcgttgccccaaatctccaattgttgctcgatagcgtcctcatcgtctaaacccggcggttgcggggtatttgacgctgatgatatgtgggagagacttttgttcaagttcaatagtgccttttcagactcttggctttcttttactatttctttcttgatggtttttagatcagtaattggatggttgaactcaggtgtaaacttataggtatggtcaggcggaaagttgggcagccaactcggtatctgtttttccagtgggttagagggaggcagcaaaacgttgatctcgttctgttgctcctcgatattattcaattcgtcctcttcatcttcttcgttatgcggtaaagcagcaagagacgaccagctcatcaatttttcatattccgtggaatgcttcgatttgatgaattctgaggcctgaaactgctgataaagggagggcgcatccaggttaaactctcgaagcaacaatttcaaatctgcttgagaagcttgcgaccttctttgtaaaagtgttaaattgtgcaggttccgaaacatgccgtccatttggacggtcacgaggttgaccagctcatccaatgcaaagtttgaaatgcagatgttcaacgaattcaactggaaaagtactgttttctttagaatttcaactacgggagcatctatttccaagtgactaatttccgtcaaatccggtaggttcctcagctgaactatggtactttgggtaccggtaccactttctgacgttttggaagtcattgccctttatgagtccctcaattacacgtttgtttgcttgcttgcctctctctccattgcttttactctcttttttaaagagttcaagattttctacataaaagcatcgggtaacactcccatatacaccatttgtgcttaagctggcttctaccagtcgcgtttcaagcgactttattgatcgcatcagcgtagaacaagaacagaactatgtatgcaaacaggactaatcatcttcagttatcttactttagtttgcaactatttatatcatgttttcttttcaacttcttttttttttttcgtttatgaagccgatgctaatgcatcaatttttttttttttggtgatgagttttgaaagaaaatgaaaaaaaaaaaatttctattattgtcagtggagtttttgaacagatcaccttgtgaatctacaaactgtcctaaagtatattggagcaggacattgggtgatggcgaaaactttggcacaaggaaggaaacctggaagcggcagaaagcccggaaaagggaagacgttgagagagggaagaaagcctggcagtggtaggaggaggaggcaaggtactgggggtaaagagaccgacgggtctcagcaagatcaggagtcgcgtcttattagttccagggacatggaagctgtggacgcactgagagagttaacgcacagcccgtcgtctcactcagctcataactcatcagcagcaccaccgccgcatgcagcagcggcgtcaacttcattgcctccatctctggattatacccatcagtcattcatggatcaacaacaacaacaacagcagcagcaacaactactacagcaacagagagtggacgtcgttccgcccaagccgtttatcacccacaagatcctgttatcttcaacgggaaactctggcggccatgtgaattcaaattacaacgccgaccacagcattaatcataattcaaaccacaaccttaacagcaacgtgaacgtgaacatgaactttactataaatgggagcaatcaagacccgtcatcttctttcctgatggggccctacaactacttacagcggcctttcattgtgaaaccatatcttgatctgtccacaagcacagcagcatcaaatcagccacggacgcaaccatcgccggcagcacatatcactaagaattccgattctacagagaaaaacgcaaccatatgacattcatttccagcataccactaaaacattcgtatatgccacataataactagttgagaaaaccatagatatttatatttatatgtatttgtacttctttgagcaatgtatatttaagactgatctcaacttcagcaactgttcaaattcactgtttttcctaattaagcacaacatgaaaaactagaattttagaaagaaaaggaaaaagaataccagatggtagttaatttctcacaaaagcactgccaggtaaaggtatacagcaaggatggactctcttgaagctagattacaattcattcaggtcctgaagaacctgcaaaagacgctgcacaagaccagagactctatcacatcatcgtcgaccaccacaccaccgtcatcgcaacaaaagctgaacaatgaccctatacagttctacttgagaaactacagacatcactacgaggacttccaccaatgtttgttcgatacaaccatgaagatggacccactagatagactggacgtagtgatatactatgttagaataataagaaacttatatccgcatagccattccaataccaatgttacaaaagtgttaaacgaagtgctactcatggacatagacttggtttttgagctttgtctgccctgccaggactggaaatccctcacgaatcaagccacctgtaaagagctattccttgacttatccaaactaatccattacgacgccaccagcgtcacgcacacaccatcagacaccacactcatagacgctactacctggtacagtgtcaagacagagaggactacaaaggactataaagaatcattgcaacgaacggagtctctgcttaaggacagagacttgaagaaattggctttctttcagcagttcaattccgatacaactgcgatcaacccggacttacagacgcagccaaccaatgcaaacattttgttgcacaggatggaagcagacagggaactgcacaagaggtcgaaagagacaagttggtacatcgaaaggccctccaacgatatactggatgaatccgaatttaaaagcttgtggacgcattttgaaactactgattccggatttgataaggacgattacaaaaacatcaaggctttaaatgacattgcgaaggcatcttacatgtattagtaccatgacgttatatatatatatctgtgaagagaatccgtatctgtattatatatatatatatatgtatatacgtatcaatgcgcgtgcaaaatgaacttatctttttcttatctcgatttcaggaaaaacaaactattcaaagtgaaacggcggctaattttcctctaagttacttttattgtagtcctcaacatgtgcagacgaataaacttaacacggtttgcagagtgtgttgttgagtataaaacagtcaatttctgtggatctggccgtagcctattactgaaaacacacaaaagaggagtttgaggagacctaaaacaagccaaggaaaataccatgttagactactcccttcattcgatggttttacgccgcatttctgcacaaatgaatttacattcgggctgatatggttgctacataagcgaatttaaaatttgagaaggttcattgttgccttgtggttcgagcttaaagatcataaagaaccgcggggaatttgtctagttacaagctggaaaggactgagcagaggaagagcattcgttcacagagaggtccacgatagaaaagtgccaagaatattacttctttcacatcaaaaatgtgtgacggttcctttgcacgttgaagcgttatcatttttttatgtatatacggcaccggtttttcgccttttcctgttcgtatatttatagtcgccccgccattgctcgccctgttcctggtagtctaggctctttgcatttctcttttggtgatttttattttttatctgccgttaccaattaagaaaaatttctgaaattgtccaacagatatgcgtaaagcaaatattgcaattatcattttgtgcataacttaccaataattgatttctgtttctgtaggatttctcgacaagaatctcaacttcttacccgttttggccaaggactttgcaactgaagcagcagatttgagatatattctggggaacaaaagaagtattaatgacttttacattctccacttcatcaaggaaaaatgggagacctcctttaaaatcagtttctacggaagataacattcatctattgaggaagcggcgtcaacagcagctgtcaagtaattctacagataattcgctgcatccaaatagtgggcagactccacgtgcaagtgacagccaggacgatgacatacgcagcgcttcaacaaccaatttagaccgtttacgacaagaacgagaggaaaattcactggaaatggactgcacacagtcaagattatctcatagagcaaatatgctagtggatgtcctaccatcttttgagatgtataatgccttgcacagacacatacctcaaggaaatgttgatcccgatagacatgatttccccccttcttatcaagaagttcgcactcaaagaatgactatattgcccagcaatgataattccgtggaaaggtcacaattgacagcagtgccaggatccgaaaacgcatgtaataatgcgactgcccattctcttaccaacctacatcctctacaaacacaacatcttacaataaacagtacaagaagtggtggacagtcgctccattcttcatcagacaccaatatcagtcaaataccgttcgaagatgatctaaacgactcggataacatttttatagacaagttatacaccttacccaagttatcgactcctatcgaaattgatataagaataacgaaaactgcatcaatacctcatgagcgtcctgaggaacagtcaatattgaaggaatacacctcgggtgatattattcatggttattgtttaattgaaaatcggtcctctcaaccactgaaatttgaaatgttttatgtcactttagaagcgtacatatctgtaattgaccgtcagaaagggaaaagaacgttaaagagatttttaagaatggtcgatttgagcgcatcttggtcttatacgaacataaccccaagtacgggtattaatattgtccccggtgaaagggattttgacgatgccatcattggtctttcaaacagcagagaattgaagccgaacacaaagtataagaaattcttcatgttcaagcttcctacacagttattggacgtgacttgcaaacaagagcaattctcacactgccttctgcctcccagctttggtatcgacaagtataaaaataattgtaaatactctggcataaaagtaaatagtgtccttggctgtgggcatttaggtacaaaaggttcacccattctgacacttgacatggcagatgataatttatcaataaattatacaattgatgccaaaattgtcggtaaagataaaagaacatctaagctgaatattatgaaagaaaaagaatataacttgagagttatgcccttcccctttgctggtgtcactaatcaacaaaacgagaaaacgtgtttgagacaactgaaaaatttggaaagcttgattgaagatagatttgaagctttgaacaagattttcaagaaactggaattaaatgaggccatttcgaatgtagatattcatgacacagatataagcgggactttggacggtaatgaagatttggattccgatgagatattaagacgtaagctagatcaactgcacatcaataacaggattgatgataccgccagccaatcaccatcctatgactccaaaaatatggctccaaaggaaaacctagtcgagactgagttacgctataagtttaaaaataagaataaatcaaattcaagtttattttctcattttttgagttcatcagaaacggggtcatcttcaactggtccacatgtatataattccggattgattgtattatcagttaaaaaaccgcaatctgcattaccttattggtcaccatcattgttgaggaaaaccaacaaatttgaagcaaagagtgaacaagaaaaggaaaactggcaaaggttaatgggcatgcttccagaaggagtgaaaaccccactgaccaagttagatgtacatttgacttgtatccaatctaataatagtgcaggacataagccgccagaaattagctctgtaacgacagaatttgtggtcatcacagcaaagtctgataattcgattcctatcaaattctgcactgaactgttgatgaatgagaatagattaaacaaactaaagacaaaatttttgacgtatcagaaaaaagttcatgaatatcgtaaaaaatttgaagaaaaccatgcgaagctaaacgagctttataatagaaatagagatcatttcactccaaaagagcttttgttcacaaatttcatatctgatcaaataaacaatgatattgacagtttagctggattaaaagttaacattattgatttacatgatatcttcaaaaagcaaatacatacttttgaagaagaaaacgaggatattatttcgaagaaaggaagttccaatcctccttccgcgtcatccagtaataataatttcttacaagcaacatttagcaatggtgcatccaccgctactaagtttactcagcaaattgtgcatgaatgggaaaaagttaagccattacagtataagagggatgttacagttaatttgaagctcaaccccaacattaaagaaacgttagtgcccaattttgaaacgtgtttgtgttgtagattttattgtgttcgagtaaacatcaaatttgataaccacttgggttctatgaaagttgatattccggttgatgtgaaaaagttacaaatttagaccataccacaccaacagtaatctcgcagttttacaaataattgataaaagcaggactattttctaaccatttaatatacctattactattaatatcattaatattattatattatgtacagtcacttatttttttttttttttttttttttttttttttttnnnnnnnnnnnnnnnnnnnnnnnnnnnnnnnnnnnnnnnnnnnnnnncccctagtatatacgaattctgcatatcacagcaaaatatatggctatcacatggcacaggtattactgaagaagaagagagacagaaatagtataggcatgttttactagcttcgattttcttgacaaaaaaaaaaggaaatttgttctatttactttaaactttaatgccccaatggatggcacatataccaaaagttaaactttcgtagccagcagatttgaatcctgccttttcaatcatggatttgaacgtttcttggtcaggaaatctttcgatagactccaccaaatactggtaagagtcgtagtcattagcaatcatcgagcccattacaggtaggaccttagcccactgttggtaagcaaagtccattaggggattctcaattttggaaaattctagacaataaaaaataccgcccggtttcaaaactctataagcagtgtttaaacccttttgaatatcggtgaaatttctgataccgaaggagactgtgtagatgtccttggaatcagaatcaatctcctctagtttctcaccattagaaaccaaaaatctcacacgaggatccttgaaatattttccttgttccatggctctcttctcaccttctttaagcatgtcagggttgatatcaacaatatccattgtagactcagtgtcaccaaatttcgactcagcatggtctagtaatccgaaagcaatatcaccggatcccccagccacatctatgaagttcaaaggagtcgtagagtttggcctttttcccgcatctagtttattgataaaatggtccttccacaatctatgaattcctaatgacataacatcattcatcaagtcataccgattggccacggaagaaaagacatcaccaactaacttctgcttggtagacttcaatacagtcttcgaaccaaaatgcgtatacttctgctctggctgttcagctgtggatgataaaggactattaacttcttcttctttgcatgctctgtgagcttgcgtaaaaaacctagataatcttagcgggacatttaccagcgagcttcgaacgatccgtgaagaaatcaacatgatatctttcttgctgcgatctgtactattccctttgcaattgtaacagcagctgtataaggagtgaaggtggcagatatccttatagtttcttgtgtgatccttttttttccactttttcagtttttgccaaatgcggaagctagtttccatattagggaagagcaggcaacagggcagaatcctttacggaaagactttcatttaatgatacatttgccaaataactgtgttccaatatcgagaacagaactatcggataccttgatatttgctcaatggtgtcacttcccgtttttgatatgtactcttcccaattcagaaaaattctcgcacttttcccacagagaaaaccgcaaaactcagaaatttaggctgtgtatcgccgatagtatcacggccggttttttctttnnnnnnnnnnnnnnnnnnnnnnnnnnnnnnnnnnnnnnnnnnnnctgcaaaatggtcacattggacctagaagtggccttttgtagctaattataagtgcataattattgtgaccagtaacatttgctgacgcgttgtgcgggtagcacacgccgcgtcttatttttgttttcatctcatcttcgttagatcataataatatgattgaaaactggagtaaaacgctaaagaacagtgtcaaggttagtagtatcgtatactttacgttgatcacgtttgcactatagactgaatttaaattagaattttatggtactgatggaagatgtgcaaaacaaagatggccataatactgtagaaaacagtagtggtggtacggacagtaataataatattcaaatgaggcgaatgaggaagacgcagctgtccaagaaggagctttttgagaagaggaaatctgacgtgttaattgctgccaagtctttagatactgaaattcagaatgtgaaaaatttgaagcgattgtcgattggttcaatggatttggtaattgaccctgagctagagttcaaagtgaacagtagaaactcatattcttcagattcctcaaaggaatccctacaagaatcgctccatgaagagaacattatacgatcagaacaaaaggaagaacaagggagcgaagacaatgatgcatatgaagagggcgatgctactaatgtcgacgacagtatagatatcactcaaacagagtatttgcatgatgaagaaacattggagaaggaaaaaatcatccgtaatgcttcttcatccacttcatcttcagcaagagtaacgtcgaggaacagaaggctcagtggagtaaagacattggctcacgatgttgtattggatgtggagaacgaccacgattcaaaaatggttgatttaactcaaaaccttttgtgggtgcccgctgaccaacatcctaacgttaagcccgaaaactatttggaattgatccaagacactttacaaaacattcaaataagcacaaatcaagacattgatgaaaacaaattagaactgggtaacaatcatgtaatttcgaatagaaaacgcacgggctctgtagttagaaggccttctcggttgaagacatcttataccaaatttgatgacgagcctccccttgcagacaaaccacaagaaggagaaatacaagtggataagcgaatatcctcatctgacatcaaaaccataagatctgtatctttgaaagaaattactgaagagcttactaagatttccaataatgccggtttaacggactcagatgcggtgactttagccagaagcttgagcatgtcagggtcatttaccaacgaaagtcttcatttgaacggcaatcacactgaaaatgataacgaatttgcatcaaatatgtttaatgaaactggacttaccataccagagagatcttctctaaggaggtctaaattcaacacatataagatcagactagagggtagtagccttccacaggcggtaaaactcaatagcctaatgaatatacaaactaatgacaatcgcagaagtgcatcatcgcctgccttatacacacaagtgcctcaggagcaagcatcattgaatgattttcacgagattttcgaccattacagaagaacaagtactgattggagtaccgaaaatgagaaatacgttgatagcaccaactactactcggatgaagaagatttgacgcatgcatctatttctcaagagagcagtcttttatctacagatagttctaacaacagcgttttaataaagccgcataacactggttcgatgatttctgaaaaattggatcagcacgttagctcgagtgaaaaatcaaataccaataacagcgaagcaaatcacggctggtcatggttgaattctagcaatggaagtttgaacggtaatgaacaaacttatcaacagcttacagatgatgaagacgatgaagaatgtgtggacaatgaaaaagctgactttgttaacttgagtgtatcgaggagagcgaaatctaccaaacgtgcctctgaaagaataaaccattccaaaaatagacattcgccaattttccagatacattctgaagaagcaaaatccgtggtaatcactccttcagtcgtttcttcatctgaatcccagccatctaagcctactgcaccagcagccgtggagaaaaaggtagaactgcctactgacacccaagccagtacacataagaaaaattccttggagaaaaggcttgccaaattattcaaaagaaaacaacatagtggtacctgcaaatcagatgtgaaagtaatcaaaaaaagtgttaaaaaagaactgaaaaagaaggcttcgcattcgagtttatcaaaattcaggaaaagtcccaagaaaaagccccaagaagcggaagttgaacgcccttcatcccccaccaaaacaattaccaccgaagatatagatacagcaagcgtcattgaaccagaagtgagaagttcaaatgcttccacccttcttcctgacagccatactagccacagttctgaatttgtggtggaaactataagcgagttagatggcgacgattcatttgatattagtggtggtgatgtaaactacgacgtcgaagtgcactctagtatcagtagagatacgacagctggactagaagaggatataggagcagagagagaagacaacacttcacctactgcccctcaaatctcaactttgcctccaagaaaattgacatttgaagatgtcgttaaaccagattacccaaacgctccaataaaattcacagacagtacttttggattcccattaccaatgataaccaactctacagtgattatgtttgaccatcgtctaggaattaatgttgaaagggctatttacagactcagccatctgaagcttagcgatcccgggagggaattaagacaacaagtattgctaagtaacttcatgtactcctacttgaatttagtcaatcataccttatacatggagcaggtgggcactggagatatagccttcaatggtgattctgccttgggaatgatggacaaaaatgattctgatggcacaatcttaattccagacatttaactcataactgtttacaagattgatagatacctatataaggccacatatttcaagtattgtaaggatgcccttttagtgtcaaacttcttattatcacgaaaaacgtcgtcttttcatgcaaggaaggactacagtatatacatataaatatatatttatgtaattatttttttcttttttttttaaattttctagcgagaatgaagaaaagccgacctcatctcatcctatttggaacaaattcgaatgatctgtccaatacagcaaggctaccttgcggttgaattctatctcgtactacactaagacgaaagagaaaaacgaaatgtccaagagtaatacttataggatgctcgtcttactagaagacgacaccaagataaataaagaagatgaaaaatttttgaaaggtaagccgggaaaaatgcatgaatttattgacgagttgatacttccatttaatgttgacgaactggacgaattaaatacctggtttgataagttcgatgccgaaatatgtataccgaacgaaggtcatatcaaatacgaaattagtagcgatggtttaattgtacttatgctagataaggaaattgaagaggttgtcgaaaaagtaaagaaattcgtcgacgagaataactgaaataatgatgttgcttcggttttttgcatgaatataacgtggctgttgcgtatgcatatgtgcacgtaatttaaagagagagtgacagaatctgcgcatcagcatgggggcatatacaagcatatgagaatttggataatgtattacatctaatttataaagtttgtagaacagcctctaatttatttagtctttctcccacgcccaatttcgttattagtttgtcctccttgccgattaactccagcaacattgtgggcaacaactctttgttgtaataccgacaccatagagcgtgtccgttaaattctgtatattctaacttcttcagggatgctcgatgaaagcaagccgtgcattgaaccagatcatccttctggaatttcgtgtagccgagaagcaacagacctacgagagaatagtctttacaatcgaaaaaaaatgccagtttttgtatttctttctcagacaggtaatgaaatatacgggaagagtttcttttaaggctaaattcatttgatccggaaacaattctgtcaatttctgtatgaattctttcaatttcccttataaggttttgtgagcttaaataatactctttgtttaaatcaacctgattttccctccacggacacttttgaagatgatttccaattatattgcaattccagattttttcattcaatttcatgttgtaatcggcgacatcatcgccattttttaataaaggaattgtcataatggcatggcaacaacagcacttaaatggcacttgcgactgggatgcactttggtacggctcccagcccttggatgctagagtcagtggattgacccatcgaacgtcccattcaatgagcacatgccttgtgtagttttgaatggagcatattcttttcaacaaggcccgaagatcgtgtaatcggaaaccaacaaaatgtttagagctttcttgtaccaaatcatcatacaattgcacgtggctcttacatttttcaggcaacattgaactgccattatgggatttcttcttgtacctccatttggtaataagtcgctctcctagagtattcctatattttcccggtaaaagtttggtattcttgtccagcgaatgtctgatagacttcagtctaacctccaatgcgtccttttccattagtaactgccctactttcctctcaattcctggggaataatgttttatttctcctttaccatagatttcaagatgacagttactttcgttccaaatgaccagcgcttgaaaatttttcaaacattttccatattcaataagcaaaacaaagagcattttgatttgataacaattgtttggtagtttgatctcatcatcaatcagaggtttttaacaaatttattttttgaatacatttcaaaaggaaattgcattttgtctttttttttttgggagaattttgtggggtatttcaatcattgttccaactttacgttccttttttgaataaagacacttcttattattaacaggcttttatttgtcaaataagattcattcaaaatttccataaagcattacttctgcgatatactactaacggaattttggttgcgtattattgtgtctgacattgtatgaaggatacacaaaaaaaataaagattaagaaagttattcaaaatgcctattatgttggaagactaccaaaagaactttctagagttggccatcgaatgccaggctctaagatttggttcattcaagttgaaatcaggtagagaatcgccatatttctttaatttgggattgttcaatactggtaaattgctttccaatttggctactgcgtatgcaattgccatcatacaatctgatttgaaatttgatgtgattttcggtcctgcctacaaaggtatcccacttgctgctattgtttgtgtgaaattggcggagattggtggctctaaatttcaaaacattcagtacgcttttaacagaaaggaagccaaagatcatggtgaaggtggtatcattgtcggctctgccctagaaaacaagagaatattaatcatcgacgacgtcatgactgctggtactgccattaacgaggcctttgagatcatcagtaacgccaagggtcaggtagttggctccataattgctcttgatagacaggaagttgtgagtactgacgataaagaaggactcagcgccactcaaactgttagcaaaaaatacggtatcccagtcttgagcattgtctccttaattcacataattacctatttggaaggcagaataacagcagaagagaaaagcaagatcgaacaataccttcaaacctacggtgcctccgcttaaaaatcagttttttaattaaatgatttatttatctcttttaagaactattaatcttagttactacgatacatgcacgccgctcatctatatatgtgtataaatagcgtatattcacacacatatatatagagcgagagagttttcttgttacttttttctgtgtttcggtacctcttgcctgtagctgcttcaaaactcttggcttattgaactctgtttcaactacagacgaaataatacgaataattgatttgtcttgatgtaaaaatttaaaagctgatacaacaagtcatttagcacttgatctgaacaaacatcatattcttatagttctgctattataatctattaatatattaatatattaatctcaatatacatatacatatacataaatgggtaaaggagacaatcatcttctaactactttgtacttattttttggtggcttgaacgacttttctgccgctgtaatcttaggagtttcgtaaacagattttgtcattgggtggcccatcaagaacggactatgcagcggaacaatctcattcattttgaatccctttacacgtggaatctttttgaattcaatattgtcgaaatcagggccatatggaatctcccttaaagattcaatagtagttggatgtcttttcatatactccccaacagctttcattaattgcctctttccacctttgaatttagtggctgcgccaattaattgtccattttctttgaaaagtacacgaattctaccaggattaccaaaatcttgtgggtgacatttttcaccttcaaaaatgcataatattcccaattcacggacagcatctgccatagttttagccaaaggattttcaacagccaactccttaggaacccttctcccttccttatgtgatctgtttatgtcaaagtaacatggatagagtacttggaatcttttgacttcttctaaatctttcttcgaaatagcctccgaacgttcaaccttaccagtttttgggttaataaaactcaactgctctttttcgttgctactattgttgttgctattactgttgttattcgtgccaggtaaaaatgcagggttctcttggtcctggctccttacaaccttaggcgttatcttgggagcgatcggcgtcctcaaagatggatctaactcggccaattccatatcaaggtcgtcgatatcattgaaatcgtcaatctcttctaatctaggcatgttgactttatgatactatagcttatggcttattttatttcttttgatttcgttagttgctagcctgttgaatatcattgatatttttttttttttcagattacaaaagcgtgaaaaataaatacttcccaattgttttaagaagaagtacacaattttgaaagcggctgaagaagtgtaccaatttatttgctattgtgacaattacactttttttttagattgttcggtacttagtcaagttttattttcagtcattacatattatgtccaataaaattgcatcaagagcttccaacagtaagctggcatttaaatacggattctgtagcatggcatggacccggccagcagcttcatgagaatctcttagaccaactacacgaccacaagtgtctgcgaagagtctttgcaaactggttaaagcgagttgttccgtccgtaacttttcaccttcgcttcttgttgcctctgccgtttcatttctttttctttcgaacagaccgttatcaccccatagcatattcttgaatgtaactattgcttcaaatacttgatcctctgatctcaatttttgaatgctgacctttatatacttttcaatagtgctcccaagaagctgttgtaaaacggtaattatagcccttcctcttaaccaacccgcgttggccttatttaaagcaaagagcgaaataaataagtcacatatctgtttaacaaaagatttattttgcgaataaaaaggatagccagaatcggtgaaaaaatgtctttcatcttcatagaaattcaattcgccgccgtcttcagagctttgtaaatcaacaacagaactgctattacttgtgctattactactaccaataggttcatgaagtggctcctccagaatatcatcatgcatatattccttgttcagtttgaatggggtaggatctatcaaaaatcttctgaaaatgttatcttcgcatatttcagaaatagataatagttctcgcaagtacttttcaagtttttgctttcgttcctcataaagcaatgtttttgtaacatgatatttcaatgacattttcacttttgacgggaataaatcttgcaactgcctcatcagatccctaaaattctttttcaaatatgtatttaattcaaaaaattcattatatctccttgccatatcccaagaacttacctgcccattgttaaaatgatggatattgatgatataataagttatttcttttaggccattactagaattctcactgaagtacgacctaatgtatatcttagtttttctgaacaaactattaccattttctcgtaccatatattgctgtttcaacagttccttcatttctagttcctttaatagggttctttgtgacttttttaaaattttcaactgcatttgattgttggtcagatctgccttcaaaatcaaatgccttaaaagttcaagctctttctcaatctgatcaattgaaatagtcaaggatgctatattatccctaaagttgtttgacccataaaattggctaggatttaggcctgaattcccgctggaaacacttactttctccatattacgtgggtgatccaactgatcctcgacaacagaaatttctgaggtattatcgttttcatcgtcgaagagtttatctttgaaaatgttgtcattttctgaaccaaagagctgagaataacggggatttgagcttattcttgatttatccggcttggattccgatccattcactatattatctaaagcatctgtgatgccggggtttgcgaatattctgacaggattcataaaatcagtcttcacattatcttttattattttgttttgttctggattgttaacaccaccgattctactcagaaagtgagcatatatatcagtcgaaatgatgtgggatgttgaaagcattttgagaaatgaaggtgttttcttgaaaagaggtaaaaatctatcatcgagatactttatagcctctgtctgtagtagtaaaacgcttttccgagctaggataaatgtgtcttcatcgttattgatttgaaaggaatttctgaaaagtattatatttttcactaaaccttcatccagcaatttcatattttgcaagttattgttatgaaaaaactttgaagaaatctcttgcagttgcattgtgctaattcctgaataaccagaaattatatcttcagatgtagcatcttccaagggatttttaaatgattcaattgtttgcgaatactctaaaaatgttgaaccctgtgtttcaggaacactgcctaaaaatgattcaaaaaaaggaagaaactcgctatcgtctacaatgtccttcaatgtgatggaggtaagaaatgaagccatttccttcaatactattccattatccatatttaaatcgggataattagcctctcttgcaagctttttgcttgccgtatcgatttccgagccagggaccgataactttgattcaatcaaatttaaggaaagcagtaatcgtttcttatacttcaaattttccttggtcaaatgttcattttctttcaattggtatattttgagggccaatgaatacgcaacatatttgatatcacttaaatccaacaaggagtccaactggttgagataatgctcgaattgttttccagtatattcagcgttaagctccaatttttcacttgagagttctccaacatctttgttcgctacgtcattcatcacttttttatgatcttgtaactctttactcaacattcttcttatcttgtgaactttgtgtttttcctcgaaataattttgtgaaaggcttacaattcttaaattccaactatctggatcagtaaatttgaaaattaatggagaaataatgcacgtagtgagaacttccgtcattaatgtgaaaacaagcaatgaatctaactcatcattatcaaaaaggtgaggaaggagcccgatcacagttttccttatggatttttcaatttctttctgaagagcattcggcttcaatgataatgatttatgtattttgtagtttttattaaactcaacggcaatttgtagatcgatgttggctgatttatgcctttcaagagtcaaatcgcttagcacagcttctctggcatcacaaaatgtgctgaaatgtttgttaaatataggcaacagcttcagaacaatcaagctggcactatcattcttcatcaacttgtccttcaccactaggagcgtttgtaataatctccactttattactttgaggaactctgcgtcactattcttatcgatttttgtgaaccaaggctcaacaaaatctttaataattaaattaacaatactctctaattctttcccaatttgcgcgttcccatcttgtattaaaccctcgacagacttcaattctttatcaacatccacagtattcgaactttccggtacgatatcaacaaatcttggctgaggtttcggtaaatcaggcaaggatttgaagaatacgaagtacgcaaagatgcagacattaagaaagaaccccagcgaaaaagtgattaccgaccattgtatcattgatattaagtaaaacaaaactaaaatcaatcgaaactgtggaaacttaggcatacgatatcatatcagaaggcaaaaacacgcgcacttatggcgctttcaaagcatgagagtcttcggttaatttacttatcttattgtttacatatttttgaagttcgtaaggcgatgaaaaaaaaaaagtacacaatggatagaactgggatggaaaaagctcatacagtcgcagtccgcagtatagcaaccaagggccacccttgcacttgcactgttcattattatattatgtagctttacataacttacaaaataagttaaacgtccttgaatagtgaatcttgtaatgctttaatgtctctgcttatacccttgacgaactccaatctgcttgattcatcctccaactgctgttgctcttctaaagttgtaggtattattcttgaattcaagtattttggatgtgttagaaacttgcttaatgcagcgcttaacctttttttatcatgttcagaatctagaccaataaccaattctacagcttcttgttgatcatcagagtttttaggctgaataaacaattcttggtaatttagcaagtttagcattttttgcaataaaaccaattgattcgtttcctttatcaacgaacttgacactgctaacttgttgtcaccccagttatatattgtagattttatttgttttccaaaatatgaaacaaataggcatgtctcaggtaaaaccttgataccgaactgacttaatagtagtagaacaatggataacaaaccattgctccaaatgttgtgcaatctaggcgaaaattcaggttttatatcaccttgctgtattgcaacagatagtggactttccaatagaacgctatacaatccactgttgatgagttttgcagcaattggctcaatagaacacaattcggagataaaggtcagagtaatttgcccaagaattggttcatcgttaatccttatcaaatgcgcgcttgaatataggttcagtataactttcaaagttccaacttcgtttagggatgatgctagaataacattgaagtttttagagggattcaaattggtgatcttcttgaagagtgataataataacaataaatcctgagtattatcctccaagttgacaatttgggtggtgtgatcggtgcttaaacccctcgtggagcatttattaatctgacataatatctcagacagtatcaaataaacacccttactaaacactaattcaaaaaattccagtagttgatcagatattaattcgatgaaacgatctcctgacgagactaactcgagaagaactaagacagatctcaaaagaggtctataaaagttattttttagtgacttaccaatatttttaataaagtcaatctcaccagatttgaaaattgtaaaaatcttgttcatcaattcaattatcttttcttccttcaacaattttcccgacaacttgaacgaatataaaatgtaaaacgacaactcaattctttccagatatatttgggtaaacatttgtttatctgaaccaaaatcaatatttaacttgaggaaatgctctaccaagtcgacaaaaccatcatttaacggaacagtgctcctctttacaaacgtggtgattagtgcgccccatgcttttgcggtagaaatttcgtaattgacatactgcaaatttaatgaagcgtctgttatttcctccttaaaatttgtctgactcttacttggttcgttccaactacggtcagcttttaaaactatatctaataacggaatatcataaccgaaattctcattttcgtttattctggataatggaattttttggaacgactgaagctctaaactgggccatttctctttaaattttaagtttaattcatcatgaaaagttttattgaacccatcaatttggaagaaatgatgaactaattcaaacaagtcttcctgattcaaaaaatttaaaatttccgagtttgaatcagtggagttgtaaatacacaacgcaaatatttctacaatccttgagatcaatttgtatttcttaatcaaagaaacagtttcgtcacgagtcaaattttcctttttctgaaataatttttttgagtccttcaacttagccaataaggaattcacaaatttaggatcttttatgaatattttagaatttgtccaagtgtttaaaacatatgttatcgtttctaataacttgcaacttacttcttcaggcgttgaatctaatagtaaagaattcttttgcaaaacagttaatatagaactctttttgtctatggaggattcgtcattaattcttttattggaggcaaattgacctgttaagaagaggatagataacccatcttgtttactttctaatagggtagtaaaaaaaatgtacaaacttcggagaaggttccaatcttgcacgggagagctcaggtccgacaggacttctttcaaaaatgccattgactttgcttcaccaaggaaagataacagaaatggatagtcgtcattccaaggagcctctactaaatagcttaacaactctatgatctgcactttgaaatgaacataacttggtagggtataaacgtcaaccaattttgatgaatttatgaaaagcaatttttccaggttgcttggctttaaatcacgattgctacctcgaatagagatcaaaagcgtgcacagcttgaaggagttattcattaccttgctatataaattacccaaaattttgtcgcctaaaatttttgttgtggtattcaatggtgaaatcagaatattcgtcaaagtatttggagccaaatcaatggaatccatgggagtcaaaaataactgcaacaatttgtttgctgacgaggaaatgattaactgatccttttgatgtggatttatggtgaaaacgtcatgaagtacatcataaaaaattgatgtcaaatggaaggcaatttcgaatttttgtaagaagttgttgtacttccagttgtaataactctcaaagatatgaattgcatgtagaatcaacttattaataatatcaattttacctctcttggaaatatggatatttttcaatgagagagattctcgaataaagacttttgttagcttaagcaattggatagtgaatgtgtaatcccccgtagataattcaaccgaaccgagtatcatattggaaagaccagtcttaccatatttgtctaacaaatccgatttgttcaagtaagaagaaacaagatgaaggtaattcggtgtcagcatagtcataaattcacaacattgtacaattgaggtataatcttttctttgtagtgatatttcaaaaacctcgaaaattacttggataatcgacgctccatttatggtgctggctgaagtatccagagaatttgataaatatgacagaatttcactagatttctcgatcgaggttttcggatcgacaacgttagtgactaactttattatggatatcatcaattcatgttgtaagtcatccagttgtgtacccttttccatatatgaatgtaatagattttgcaatattctacccaccaaagaccaaccattgaatttgtaaaggaaaataatcaaattggaagtagttggcggctgttgtccattctgttgttgttgttgttgttgtttgatagtaagaatttttccctttgttgattttggtattgacaagagacaattagagttttcgttttctaagggtggcgccactagtaaatcagacttcaactctatcaaatcaggcactataatatcggaggatgaagaagagtttgttattgtatcagcaattaagtcataatccaaatcgttcaaactacttttggtaacagcaaatgaacatatatcttttaattcaaaattggcaaactcggtatcaattaaggctaaattaattagcgggatcagtgattcgttcaataggggcaatttagcctttatgatgctcaattttttctcaaaagtgtcattagttaagaaattctcaatgaactgctctggtgcctttgaaattatcttggcgaaaacccgggaagtagatgcagttataggaataaaatttaaagaaaactccaaaaatactgttattactgtggtgtaaacaggatcaaaggatagaatttctgagagagtattcaatttttgaagaacatcatgtgattcagcaaacagagcaaatttcgttatgtctgaatcatcaaatgattccgacgattgtaatgctcgcctataataaagtataaatgaccaggagtaatgaatcattggatggaaaatggggtcctcgttgacgatattggttgctacatcattctctagagcgctattgacggtgtcgaaagtttctgtatccatgtacaaaggtgactgaatatcaaattgcgcgattgaagtgttcagtccaagtatcaatatagttgtgatagtaaataaagatgaaatcctggaaataagcgtttctgagaggtaactgaggtcttggaaattctgaaacttgtacaattgtagtgacgaggtatctatactcttgtctgttgaatttatatttctgcaaaattcaacaaattgattttgatactgtagaaaccattgattgacgatatctactggtacttttgtgttgaggatcattaaattcaaaatttgtaatatctgcaagataaacttcaaatcagaaaatttttttaactgcaccaatgagacaattgtgaacatgtcttgatcgttattataatcatgtgctaaagatgaagctgtaataatgtcgtagttctggattacagatgatattatagaaatcaatttccccactacattgaatctatcgttgtcaataaatgaatatgtctcgaggtcgatgtcagggttaacgagaagtgagtatactatatgaagtctagatgatctctcagacataaagaattctacagcatgagaaaggtcctcagattgagcaaagaatggatcattatcgacgtttatttgcaataagtttgcaattgtagagcgtaacttgttatgatcgccggaagaagttacattctgccttattgtgttcagactctcgataagatttgtcttgttagctttcaaaaactgtcttatttgggccaattgcttggcatccacagcggatacatcagcagcagcatcgttcataaaattagcaacatgagtgaaggtcaattgtggagaggaattgccaaatgaaggtgtagccatggctgatggggtcctttttttagcggtggaaagggttatctctttatttgtgtttctgttcgaatattaaagatgtctcaaagtattcatttcaagaagaaaatttttggtattacaaaatattcttacccggaatatatacatatataccttaactacaagcaggagccggctttctggcaaggagggagaagacatagattgtttgcgtatatatgtgggaatagcgtccaagcacgcccgtggctgagggagcaccacgatcgttcggtgtacttgacacctctatatggtatgttcttccctgatattgatatcagcacaattacggctctaagaaacgatgaatataaaaaacgttaattaggaatttgacatatgtgctagtattcgggcccctgagcaagtttgtgcgcacgacgcctgtccgttgctgcacatgcttgcgtggggcctttttgtcgtgtttttatttagggactgttatcgaaggaatagatttctgtggtgaaaagtagaaaactactagcttttatagacggtgggggagaaaaaggaaaattagaattgaaaaaaatttgaaaaaatatgaaaatgtgaaaaggacgccttatttccttgggttgcccggcgaacacgttagttaactcgctgtctaactgatgggctattattatagcgttatagtacgtatcagaatttaaaagaaggaggcagaaaagcttagagcaaaggggcaggacaatggaagcttcacatttgcaaatctactggcatgattcacaacccgtttactcgctcacattccaaaagaacagtgcgaacgacaagcttttcaccgctggtggtgataacaaggttaggatatggaagttgaacagagatgaaaacggacaaaatgggggggtgcgtaagattgaaagccttgactttcttggctcgctgacgcatcacgaacaggccataaatgtaatccgattcaactcgaagggtgacgtactggcgtctgcgggcgatgacggccaagtgctgctatggaagcaagaagatccaaatacacagcaagaatctgtggtcagaccattcggaatggatgcggagactagtgaagcagacgagaacaaggagaaatgggttgtgtggaaacggctgcgtggtggtagcggtgctactgcggcggcagagatttacgatctagcgtggtcacctgataacaggaacatagtggtggcatgtatggacaattcgatacgactgttcgatgttggagctgggacgctggtatgcggccagtcggatcatggtcactacgtccaaggtgttgcatgggacccattaaatcagtttattctctcacagtctgcggaccggtctctgcatgtatatggagtcattctttcatctgcaggagtggttacagggctgaaacttagaagtaagattgccaaggcagaactgccttgtccaggtgatgtcctgaggacaaattacctttttcacaacgagacgctaccttcattctttaggcgatgcagcatatcgccttgtggtggtttggtggtagttcccagtggtgtgtataaggtggctggtgatgaagtcgcgaactgcgtatacgtgtatactagatctggaatactgaacagcgctggtggcgttaaaaaccggcctgcgattagaatcccatctttgaagaaaccagcgctgatggcggctttctcgcccgtattttacgaaacgtgccagaagagtgtgcttaagctgccctataagctagtatttgccatagcaacgactaacgaagtactcgtgtacgacacggatgtattggagccgttatgcgttgtgggaaatatacattactcacccataactgatttagcatggtctgaggatggctcgaccctactaatctcatcaacagacggattctgttcgtatgtatcgatcgacacagaaacgcaattcggttcaaggatagagccgccagcgatgcatgcagagccactagacactgacgagagcgcggtagcggctaagaaccagcgcgaggcaggtgggatcgtgaacatgctgccggtgaagaagatcccctgcaatagtagcgatagtaaaaagaggcgcatacatcctacgccagtcgatttgtgatttttaatatatttaatgcggtacataagaatgcctaatctagtttgccagcgaagatattttccattgtgtgctcaatggaccctgtgttcctgagatcttgcacgactttttcctgaggcacatgtggcgccatcgtcatcacgatttcaaccatgtcactattaacggctctctttcgatcactaccatgtctgtttaaccgagcaacgcgttcctccggagccgatggtactggctccggagaagggtcgttggtggcgaccgagggcgccggtttggcatcctgtacggttcgcgagggtacttgcttggcgcccctgtgtttcacggtgtaaacaaacaagcacaccatcgtcagtataaacactatagtcgatccatccatttttacttttgtgcgcgtgggtagccgtgcctcgtctgtgtgtgtgggaatgtataaatgtgtcccgagttattgttctaaagcgggcaccattgtagtaacttattgcgaaatttctgctcttctcgtctcgctcaaaaatcgcgttcagggtaaaaggggcgaaacagagggccagatagaaatttcgagaaaagcgggtcacccccgcccctgcattttgatatggcgtatttgggattgcttgctcgaaagtgtctaagtccggttggcgggcctggcgccctcgccgaagggagataggaaggggcgggggtccgggcagcggctatggtgtcagttacctagggaaggagaagggggtagaaccaaggggctagcacactcaccctggggcccccgtctagccaagcttaaatataaatactaatgtaactataaatataaggatctaccgtgtcattgcacatccacccacccgtcgattaaaaaaccaaacaaagcaaagaatacaatagcaacgcaagatcaacacaatggctctcatcgtggcatctttgtttttgccctaccaaccacaattcgagcttgacacctctctccctgagaactcgcaggtggactcatctctcgtgaacatccaggctatggccaatgaccaacagcaacaacgtgcgctttctaacaacatctcacaggaatcattggtcgcgccagcaccagaacaaggtgtccccccagcaatctcaaggagtgccaccaggtcacccagtgctttcaaccgcgcctcgtctacgacaaatactgccactttagatgatcttgtctcttcggacatattcatggaaaacttgactgcgaatgcaactacctcacatacgccaacaagcaagactatgcttaaaccccggaaaaatggttccgtggaacgattcttctccccttcttccaatattcccacggatcgcatcgcatcgccaatccagcatgagcatgactccggttcgagaattgcttcgccaatccaacagcaacagcaggaccccacggccaacttattaaagaacgtcaacaagtcattgttagtgcactcactgttgaacaacacctcacaaactagcctagaaggacccaacaaccacattgttaccccgaaatcgagggcgggcaacaggcctacttcggcggctacttctttagttaataggaccaaacaaggttcggcctctggatcttctgggtcttctgcgccaccttccattaaaaggattacgccccacttgactgcgtccgctgcaacacagcgccccttattggctaaacagccttctaatctgaaatattcggagttagcagatatttcgtcgagtgagacgtcttcgcagcataatgagtcggacccggatgatctaactactgcccctgacgaggaatatgtttctgatttggaaatggatgacgcgaagcaggactacaaggttccaaagttcggcggctattccaataaatctaaacttaagaaatatgcgctgttaaggtcatctcaggagctgtttagccgtcttccatggtcgatcgttccctctatcaaaggtaatggcgccatgaagaacgccataaacactgcagtcttggagaatatcattccgcaccgtcatgttaagtgggtcggtaccgtcggaatcccaacggatgagattccggaaaatatccttgcgaacatctctgactctttaaaagacaagtacgactcctatcctgtccttacggacgacgtcaccttcaaagccgcatacaaaaactactgtaaacaaatcttgtggcctacgctgcattaccagattccagacaatccgaactcgaaggcttttgaagatcactcttggaagttctatagaaacttaaaccaaaggtttgcggacgcgatcgttaaaatttataagaaaggtgacaccatctggattcatgattaccatttaatgctggttccgcagatggtgagagacgtcttgccttttgccaaaataggatttaccttacatgtctcgttccccagtagtgaagtgtttaggtgtctggctcagcgtgagaagatcttagaaggcttgaccggtgcagactttgtcggcttccagacgagggagtatgcaagacatttcttacagacgtctaaccgtctgctaatggcggacgtggtacatgatgaagagctaaagtataacggcagagtcgtttctgtgaggttcaccccagttggtatagacgcctttgatttgcaatcgcaattgaaggatggaagtgtcatgcaatggcgtcaattgattcgtgaaagatggcaagggaaaaaactaattgtgtgtcgtgatcaattcgatagaattagaggtattcacaagaaattgttggcttatgaaaaattcttggtcgaaaatccggaatacgtggaaaaatcgactttaattcaaatctgtattggaagcagtaaggatgtagaactggagcgccagatcatgattgtcgtggatagaatcaactcgctatccaccaatattagtatttctcaacctgtggtgtttttgcatcaagatctagatttttctcagtatttagctttgagttcagaggcagatttgttcgtagtcagctctctaagggaaggtatgaacttgacatgtcacgaatttatcgtttgttctgaggacaaaaatgctcccctactgttgtcagaatttactggtagtgcatctttattgaatgatggcgctataataattaacccatgggataccaagaacttctcacaagccattctcaaggggttggagatgccattcgataagagaaggccacagtggaagaaattgatgaaagacattatcaacaacgactctacaaactggatcaagacttctttacaagatattcatatttcgtggcaattcaatcaagaaggttccaagatcttcaaattgaatacaaaaacactgatggaagattaccagtcatctaaaaagcgtatgtttgttttcaacattgctgaaccaccttcatcgagaatgatttccatactgaatgacatgacttctaagggcaatatcgtttacatcatgaactcatttccaaagcccattctggaaaatctttacagtcgtgtgcaaaacattgggttgattgccgagaatggtgcatacgttagtctgaacggtgtatggtacaacattgttgatcaagtcgattggcgtaacgatgtagccaaaattctcgaggacaaagtggaaagattacctggctcgtactacaagataaatgagtccatgatcaagttccacactgaaaatgcggaagatcaagatcgtgtagctagtgttatcggtgatgccatcacacatatcaatactgtttttgaccacagaggtattcatgcctacgtttacaaaaacgttgtttccgtacaacaagtgggactttccttatcggcagctcaatttcttttcagattctataattctgcttcggatccactggatacgagttccggccaaatcacaaatattcagacaccatctcaacaaaatccttcagatcaagaacaacaacctccagcctctcccactgtgtcgatgaaccatattgatttcgcatgtgtctctggttcatcgtctcctgtgcttgaaccattgttcaaattggtcaatgatgaagcaagtgaagggcaagtaaaagccggacacgccattgtttatggtgatgctacttctacttatgccaaagaacatgtaaatgggttaaacgaacttttcacgatcatttcaagaatcattgaagattaaattttaccattttaaaattttaattttcttgggtatgaacttttattttcaactgcttattatatatcaattttataaatttttttcttctctttaacgaccaattataaaattcatcctcttatttattacagcatcttatacattatgtatatgggtagctattattcatttttgcttcgtaaggtctttttttgtcaactttttcatcctaagcggctaaaagtgattggagaggaatgtccaggcgaccaatgataaaaacgctttctcttggaacaagaaataggagcaattgacagttgtcgatgaacagcgaaaatagtaagataaccttcaagcccaatattctaattaaaggcgtttatatatttgtactttatggtatgtgcatatgtattgtaaagaattatttcaagacacagttcttccagctactggctccggctattcatgaaaaatccaaaaataacatatttatgatagcatcagattcatttcccaatctttataaatagaataccaattatcgcccggctcatcctctttccgtcgcctccaaacttccaacattacttgcctggctccccaataggagcccactccactttcagctaatttggctgcccatcttctaaactcttgctgtctgttttcatctgtgcaagcacatcctgccatgaaaccttgccaaattaaagggacaatttttacttttttttgatccaccaattcttccattgcatttaagtgatctaatactttggcaacatagttttgtaggaattggcaatttaaacttcttgccattgtaaaataataaataattaaactgaaataaaagctcattgtatggtgatatagtgcttcagccgttgagtttatgaagctttttccctccgaattttcttgatggaagttccattctgatttccatttcaataatcttttttcgaaatttaacgagagttcattaaattttcggggtacaggtaggtaagttaaattataatattcattatgtctcactatcctaacacagtctgaaaatagtaatattaatgaattaggcaatccatagagtgaatctgtaccaattatgttttcatcagtcttcgatactagattagatatatcagatttattatagtaactttctgttgctatgttggtaaaaattggaggagtggtcgaagatggagtagagtcagcagatacgtttgtgataggctccttaacgaattcaatatgtattttgccgtcattttcattgagtgcctctctaaataaaccttcctgcacaacgtcaactcttggctcactgctactgctagtagcgttagatgtatctaatagtttgtaattatcatcttcttcacttggcaaaataacaatttcctttgccctgactttatccaacgcagtgctatcttgaattaacttcagaaacgagaaaatcctgtgtaaggtttttgccttttcagaaatattaggtcttagtttcattcttgactcaacgaagtcttcacaaagagccaagtgatcctggcaatctgccatcgtcccccatacaacatcaatagagttcatagataagatcgcagttagtacgtctttatatttctcaggtatgcttggttttgtgttcaaacatagtcttagaaagttcgaggcttgatttctcaattcgatacctaggcccagaaagtatttttgtagtttgtagttccttgggtacttgctttgcaagtggaagcaagagacagcaagaagagcattcaacaacgcattcctcgagttggaggattgtcccaaacccgctaaatcgcctaatgccatcaaggctctggggtagtataaagttttccatgggttcttttcgagcacgaccactgtcattttatctgcaacattattaaaataatgatttaaaagaaatctcgttaaaccatgtacggtaaggtctgttttgggtataatatctaccaattcaggtggtaggtcactggaataggatgtgagttctaacatggacttaggcatgcgtgattcttcatttggaggagctagagttattttattcagatcagatgcgggcagagatcttggttcaatattgacgaacacatcgtcgatcaatgcttgagggtctggttcctcactgttcgaagagtttttctggaagagtaacttcaagttttgctggtaaagtttatcatcggcactggctgctttattaggtaaagttgatgaaccttgattatcagtctcaacggcacatccatgttctttggcattcacttgctcttccccactcacgacgttagagttttcctctaatgagatttcttgtggctgtgtgtgtcctaagtgatgtccctgtaaggtcaccgctgacaataatgcatcatctctgagttcactcgagatccattcgtaacctgttatattcagattgttccagtcataatctaaaagatttggtgttggtggaacaccatcattagcagagagaatacctgtctttacatgccctttatttctcaacttgtcttcaatatgtctaattggaaaggaaatagttgaagaagatggtgaagaggataacgaaatagaagctgagctctccaagcttttggcaactcttttcctattgcgcttcttccttggagcgtactgcttgtcgatcttatctgttcctttaaacaccccaaatttctttatgatccacgtcttgttatcgcttattttctcaattgggggagtatgcagcattgttagctcatcatccatatcttcatgatacacgtattcttcatcatagcgcacaaaatcgatgttccgtcgttggtattgtggttcatcgacactacctgataagttcgtagtagttgcaggagaattttgtgggattgggacaccgtacgggtcaaattgcataggcttagaccaccggagtttgatatcataaccgccacaaggcaaattagacttttcacatcgttggcagtcgggatgccgaagatcacacttaacttttcttcctctgcacgtccaacacccagtaaacgtctttgcccttcccatttttttagggcgattcttgctggaaattcccattatatctgcaacttaaaattttcgaggtactgatatcggtaactattgcccactaaagcatcaaatctaaaagagatgcttttcgcaaggtgtatattttttttcatttatttttgagttctagcggaaaccgcaggcgaagagtcattgataacaaagaaggttcatcaacaactgcaacatgaaatccaaaaggtaacggcaggcgagggtgagctggataagatatgtctaggaagctgaaaaaaacgaatctgtttaacaaggatgtaagttccttgctttacgcttacggcgatgtgccgcagccactacaagctactgtgcagtgtttggatgaattggtatctggatatttggtggatgtttgtactaacgcattccatacagcccagaattctcagcgcaataagctccgattggaagatttcaagtttgcccttcgtaaagacccgataaagcttgggagagcagaagaactgatagctactaataagttgattacggaagctaagaagcagttcaatgagacagacaatcaaaattcattaaagaggtacagagaagaggatgaagagggtgacgagatggaagaggatgaggatgagcagcaggtgacggatgatgatgaggaaggagtgggccgtaatagcgctaaacaatcaacagattcgaaggcaacaaagattaggaagcaggcgcctaaaaacctcaagaaaacaaaaaaatgatatagctacttggcaggcccgtttaagtaggcttgattcagatatacgtagtacatatgtccctttgatttattaattaggcgtttgctctataaaaggggttttgaggttgcgttggtgctgaacaaacacttgtcattacaatggcacaattttgaatgtattgttttcttatttatatatttttccaagtaaaatcttaggatgcaactggtacatttatttttttagattcaaaaaccctgctacattagtaacggcaaactcctccctctgatagttgtgttgcaatactcagctgtcagcattggatagttaagatgtgttgctgagtcaccgcctgaaacagcaatttaagctcccttctgtgcttaggaaggtacgtgcgcctcctaacccatctattatttgattctaagtcacaacgagcctgtactaaagagttttagaagcgatcgttatcagtaaaaaatgtctcctgcggtaagttatttttactattatatttttacaaatacatattgctaggctactctatacatgaaatatgtgcatgagatcattattctgacagagaaagtagagcatcaacacagggcccaatacgcgattttttagcaatacaaacatcctctatcaggcttgggtccatatctggaaacatattctgtaaagtgttcaacgtgtcctttcgttcgttctcttcaattttcttaattaacgaagaaacgtcttcttctttattgctctgttcagatttcaatgtctcttcttgtgtgggctctccaattggagaaaacagttcattgaatttagaaattacaatattggtaacttcgtctaagggtttcagtaaagtgccgtttggctgtaactcatccggaacctctagttgttttttcttctcttcttcctctttttcttctgctagttgtttcaaatttctttggtatgcctcttcaaaatcttcgtgatcatcgatagttaaagaacgttcagtcaagctcataatgaagttaagagcagcctgaagactgctcaagtaatattcctcttcgccccggataaagtctggtgatctgaatctttcgatgtagttcacattcgaaactagatatcgtacttgtcctttcaaaatacagtatattagtacaggtataaagctgtcagcgccattttgttccaacttggtatgttttagtaaaccaaatataaccttgcttgcattcaaaacgcaaaccatcttgtcccttggtgacttaaacctatttattttgcccaactctttactggccaaatggacaaacttattcagcctggcattcggcatagtatcaggaatatctaacataatggggcttatgaatctataatgcctaatcttttctagtaatgtgtcatcgttggttaaatctttcatatgctcatcgtctaatggtttctgcagaatttcataaagacttggtgaaaaacagcgagaatataatttccccattattaacttttccataccttccttggcatttctcatcttggaattgtcaagacttcggaaaggctcgtaaagagtgaatttatcgtaaatgaaggtcttaaagtcactgatgagttttatttcttcgctgaccgtccatagaagtctttgcgccaagaagttacgtaagaatgatttcgtatatttaaccagaggatctgcaccaggagtctgaagctgcttaatgaatatttgaaagtcataaaatggctcctcatctcctttgtcctgcgcggatatgtccctattagtttcttctgccgctgccttattaggatcatcctttttaaacttcacatctttatctgggttgccatttgcctgttccaattggctgaaaggatcaaattctttcaatatctccctcttttcatcatcagtcatggctgttgattcctgttctttgctgtttgatgaagagaaactcaagcccgttggatgtagaacttttcaaggttatgtgtcattacatcaagcaccggcagcttgatatagcccattcgcgaaaaaaataataaaaaagaaagaaaagtgaaaaaatattgaggcatcggaaagttccagatttagtaaagccttgagcatctggcattactatgagacatgtgcgggattctattgcattattgtccaaacaataactacctgaatgatgagttaattgaatttccagaaggaactgaatttggagatacaacatgtaccaatgaatcgtcgattttcaacaaaatcattccgtacatagccgcaagaggtccaaactactcctctcttcgagctgtcaaagcttatcgaataagttggttttcttctgttttatctttgaggcagcctttcacgaaacagagtattaatgtggatgacagatatttcctacaattcaatggtgagttatacaataaagagatatcgcaaggtgataatgatagtctttatattgcttctatgttgcagaatttgaaagagggtatgggcgttattgatgtcataaaatcactggaaggcgagtatgcttatactatatatgacgtgaactcatccaaactctatttcggcagagatccaattggcaggcgaagtttgtcttattcggtcaccccagacaacgaattgtacgtcgctagtgtaacggggtctgctgggtcctttcaagattgtataggtggagttatttatgaatatgatacacgaactaagttgttaaattccaatcagaggtcatatcttccatacgaagtgacatcagagatagatctgaatttcacatcattgtcagaggtgtctaaaaatttatatgctgtgctacgtgattctgtaaaaaaaagggtagagtccatacatcccaggcatattgaaaactctcctattgcggtactattctcaggaggaattgattgttcagtaatagtagcgttgatctgcgaggtgttgcaagaaaatgattataaatgtggaaaaccagttatagagcttctaaatgtatccttcgaaaaccccaggactggtctttttccccgtgatacacctgatagaaaactgtccattaacagtgcaaagactttacaaaacttatatcctaatattgatatcaaactggttgaagttgacgttccttatgatgagtatttaaaatggaagccatttgttatcaatttaatgtatcctaaacagactgaaatggacttgtctatagccattgcttttttttttgcgtcgagaggtagaggtttcttaacttctccgaatggggaaagaacaccatatcaacgccatgggatagtgttattcagcggactgggagcagatgaactctacggtggatatcacaagtttgccaacaaaccaccccatgaacttgtggaggaacttacaaggcaaataaacaacatttatgatcgcaacctgaatcgtgatgataaagtaatagctcataatggtgtggaggtgagatacccatttttagatgaatatgttataaagttatctacagcagaaattcccattaatttcaaggttaacaaattaatccttcgaaaagttgcctcgcaatatttgaagttggatggaatatcatcagaaccaaaaagggccattcaattcggtgctaaaagcgctaaaatgacaaaggatggtaataagcatggaacagatttattaaaagaaaataggaattgttcataaattcaaatattcaatatattttgcagcttgttcaaaattaaatgctaaaagtagagtaaatccgttgaacatacatagttttgtaatgtcattaagggtatcttcagagttgttatcgtctactatgaatatcagtatattattttcgtttctagataagggctgcattctcctagagatataatcgacatataatttgtgataagtcaaagttaagaacagtacacttcttccacgaactagatagtcgtagtatatcatattaattcctgttgaagatacatatctccaattggtgctctttaagtggttcaggagtggattttctttttgggtagtgttcactagtacagtttttcccggtcgagtactcctgaagggtctctttcgattatagtcatctgtagcctttgagtcggtccattcttccggtttttgctgattgaaggcgtttatgacctggtttgaatttatgcgtcttgatgtttgcggttcctgctgctgaagttttgatgcatctatttctaacgattgagatccggtagtatctgcaccactcttttcctttctcaatttggccacaccagccaatatactttcaaatgaagtaggatcagtattgttcatcttctaggataaccaactttgtttatgcccttttttgtgttgcgtggctgtctcataagttacaattttcttttttgttctaacgattttaaagagaaaagtgtcttagatgaaaatcttgctgtgacccaaacaagaaagagcactgtaaaaatcaagccatgtcctctcaaaaaagtatgtaaatgaatagctccttcgttgttgccaccgtacagacactttactaacttttaagttactgcatgttcgaaacttagtcgatttaactaaactaaatcccgagcagctgaatgctgtaaaacagcaattcgaccaagaattgcagcatttcacacagtccttgcaagcattaaccatggctaagggcaagttcacagaatgtattgatgatattaaaacagtctcccaagcaggaaatgaagggcaaaaactactggttccagcatctgcatcattatacatcccaggtaagattgtagacaataagaaattcatggtcgacattggtacaggatattacgttgaaaagagcgctgaagcagcaatcgcattttaccaaaagaaagtagacaagcttaacaaagaatctgtacagatccaagatattattaaggaaaagacccagtattccttgtccatcgaggcccaaataagacaagccgctattagacagcatgaagcgatgagtaaacaacaacagcagcaacaaaaaaaggagtcgtctacagcctaggtaactcttttgcttttcctacgatttttcatatctcatttgtagccatctgatatacgtttatctatatgcaacgtaattttttatttatcgtcactttgtagttttccggaaaaggccattgaaaatttttcaaattcctatggcgatgagctgaaaaaattcattaagtgtgcattcaataacatcttgttatatactaataaaagaggcttcaagacaaaataagctaacttaaatatggcaaaaaagaaatctaagagcagatccaagagttccagaagagttttggatgctttgcaacttgctgagagagaaattaatggcgaattcgataactccagcgacaatgacaaaagacatgatgctcgtcgtaatggtacagttgtcaacttgttaaaaaggtcaaaaggtgacactaacagtgatgaagatgatatcgattctgagtcgtttgaagatgaggagttgaactctgatgaagcgttgggctctgatgatgactatgacattttgaattccaaattctcacaaactattcgtgacaagaaggaaaatgcaaactacaaagaagaagaggatgaaggtgggtatacttccattgatgaagaagatttgatgccactgtctcaagtgtgggacatggatgagaaaaccgcacagagtaacggcaatgatgacgaagacgcttctccacaattaaaattgcaagatacagatataagttccgaatcaagcagttccgaagaaagcgaatcggaatctgaagatgatgaagaggaagaggatcccttcgacgaaatatctgaagatgaagaagacatcgaattgaatacaattacctcaaaactgattgatggaaccaaaagtaaagctccaaagagactagatacgtatggctcaggtgaggccaatgagtatgttttgccctctgcaaatgcagctagtggagcttctgggaaattgagtttgacggatatgatgaacgttattgatgacaggcaagttatcgaaaacgctaacttgcttaagggtaagtcgtcgacgtatgaagttccgctaccacaacgtatccaacaaagacacgatcgtaaggcagcatacgagatctctaagcaagaagtgagtaagtggaatgatatcgtccaacagaacagaagggctgatcatttaatcttcccgctgaacaaacccaccgaacataaccattcctcggctttcactagaactcaagatgttcctcaaacagaattacaggagaaggtagatcaagttcttcaagagagtaatttagcgaacccagaaaaagactcaaagtttgaagagttaagcactgctaaaatgacacccgaggagatgagaaagaggactaccgaaatgagactgatgagagaattgatgtttagagaagaaagaaaagctaggaggttgaagaaaataaaatctaagacatatcgtaagatcaagaaaaaggaattgatgaaaaatagagagctagctgctgtttccagcgacgaagacaacgaagatcatgatatcgctagggctaaagaaagaatgactctaaaacacaagacaaattccaagtgggctaaagatatgatcaaacatggtatgacaaatgacgctgaaaccagagaagaaatggaagagatgctaagacaaggtgaacgtttaaaggcaaaaatgttggatagaaattctgatgatgaagaggatggtcgtgtgcaaacattaagtgatgttgaaaatgaggagaaagagaatatagactcagaagcattgaagagtaaattgggtaaaactggcgtaatgaatatggcctttatgaagaatggtgaagctagagaaagagaggcgaataaagaaaccttacgtcaattaagggccgttgaaaatggtgatgatattaagctcttcgaaagtgacgaggaagagacgaatggagagaatattcaaataaataagggcagaagaatatataccccaggttccttggaatccaacaaagacatgaatgaactaaatgaccacactagaaaagagcataaagttgacgaatcaagaagtttggaaaaccgactaagggccaagaatagtgggcaatcgaaaaatgcaagaactaacgcagaaggcgcaataattgtggaggaggaaagtgatggtgaacctcttcaagacggtcagaataatcaacaggatgaagaagcaaaagatgttaatccttggttagctaatgaaagtgatgaagaacacactgtcaagaaacaatcttccaaagttaacgttattgacaaagacagttctaaaaatgttaaggccatgaacaaaatggagaaagcagagctaaagcaaaagaaaaaaaagaaaggtaagtcaaacgatgatgaagatctcctgttgacggcggatgattctacacggctaaagatagtcgatccatatggtggttctgataacgaacaaggggataatgtattcatgttcaagcagcaagacgtcattgcggaagcctttgctggcgacgacgtggtagcagaatttcaggaggaaaagaaacgagtcattgatgatgaagatgataaagaagttgataccactttacctggttggggtgaatgggccggtgcaggttctaaaccaaaaaataagaagcgtaaattcatcaaaaaggttaagggtgttgttaataaagacaaaagaagagataagaatctacaaaatgtgatcataaatgaaaaagttaataagaaaaacttgaaataccaatcttcagcggtaccattcccattcgaaaatagagaacaatatgaaagatctttacgtatgccgataggtcaagaatggacatccagagcatctcatcaagagcttatcaaaccgagaatcatgactaagccaggccaagttattgatcctttgaaggcaccatttaagtaactgatatttattggtggtaaaaaaatgcatatgtggcacattccactttttatatctatatattatgcattgtgtagaatagtaatactggaataattagaaaaaatcatttaaaggttatgtaagttatatacacaattggctttcttttggataagttgagtgagatgggtgattggcggggataattataacatcataatgcttctaatctatcatttatttcttgagaagttaattttctaaatctagggcctttatcggttggaataccagtgtagcctagcaagtcagggttctcatcgccaataatagccacttcaatggtgtcaccattgaattcgccctctaccgactccttcagcgttagtaaggcaatatgaatggcgtcttctagttccagttcatcattccatcttttttctaaaaacgtttttgccgccacagaaccttttcctatagcggtggctttccaagggaagtaggaaccggaaggatccacttgatataaactaaacccattaaattcgtcgtggccagcaatcaacagtgaaacaccaaagggtctgacaccaccggactgtgtagcctcttgcattattttggctacttcagaaaccagtaatttggtgggagggtattcaccataaattcgtttataactagtatgtgctacctttcttgatttatccactaaaactctataatcaggccccataccagaatatactgcaccaatgtccggtgttagtaaggataccttcgaaagtgtttctgacatggccagtggcgaggacgacttcttttctgtggcaattactacaccattcgtagcttttatacccaatgaggtgacaccttgttttactgccgtcaaggcgtaatcaatttgacccaatttaccgctgggagaaaaagtggtcaacgaaaaagaatatctgtcggtcataattatagaactgtgttgattggtgtcttatggttgcttgctactaattgaaactaaaaaatataaaatgcttcaccaattccactctcagcttattggggccggggacaattttgccaccttaataagctattatcgcttttcacgtcgaaaggaaaaaataaaagtgtaagcaatggtgtagatacttcttatatagacgttattattactattattattattattattattattattattattattattattattattattattattattattattattattattattattattattattattataatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattattattattattattatatgacattaattacttgtaattatgttataacagtgaaataaataaaatattaaattgtaaaggtcatgcttgaagaggcttgctcttccttaaaagggacctgaattccctgaccttttcaatattggcatcatttccactagtgatgaagctttcttctagatagctcagtatcttattgagacctttctgttggagtgaatagatcaacccattctgaaggactaacgaggaagcgtgttcgtttatataaatagtctcgatcaagttattgaacaacattgaaggagtgaaagggttcaaaaaagactcgactgaaaccaaggtcttcagttcatccatgtccaattcaggtgacttcaaataagctttgaatctgcagtagttccttactttttctctcaatttttccttcattgatttgtcattttcaatgctgggagacaatagtctgatggaatcatacaaattgtttagcatttgattcaggatttcttttttaacttttgctgccattccaccgatgttgaagttcatgaggtgatctgaatgggcaattaagttgtacgtcgatagtaaatttatgaagcttgtttggctggataaaatattggcgaattgtaatgtattttccggactttcataatacgtgatgttcctattgaaactatccaaaaataacgcaaatgtataaaggtccatagtcttatggggggttctcagctcccttggagtcttttcaaacagcgtgaatgccccttttaaatcattcttattaattaaatattctagctgaatatcaatttttgatgattcgcttattttgtcattaaactttttagagagattttcatacttcttgaattcaccagacctgatacaagattttaataaaagttccaaatttaacaccggaacaatattattatatctcaaaatatctgcgtacttaccgccgtcaaacagtctttcataaatcagctcaatagcatttttgttttcggcttgaatagcaatacttttgaacttttctgggaaatcacagactcttatgaaattcgataaggattcgcagttttcgattaattttaacatagaatcatttcttaaatttggcacaaaaactttactaaattttggattattgattatcaattgggttaggttcctaccaggaatctttgaaatcatcaaatttacgatattctttagttcaattgaatcagggcatacctctaagcacttgtcaataatttgtttgttaatagctcgtttaattatcaattctttataagtgtcataatcaaagcaataaccctctttgctcaatttcgtaaattctcttataccacctctgggtgagttcctgatgaaagaacctagcgacaaaggataagatttgtcccaatcacctggatgattgaaaaagttcaataaatcttgtccattagcggtgtcatctaggttaaccattttcatagcctgagatacgacacctgctaacaaattaggatctaggtttaatctgcagaagttttgagctaacattttaaactgatgttcaatttgatctctaaacttcaaaagaacctcgttgttgccattttgcaaaattgggtaagtgtcaaaatcaaataattttgttaccaaaattgcatgaatctccagaatgtatgggaaatcctttattgtctttggaattttaatgaagttattaatgcatgatattagcccattatagctgaccatttcacagttttctaaattgaaatcttctacgaagtttttgaaaaactttgcgtgggatattttgtttaataatgattgtgattggaaattatcaactatcatatttaagaattgaaatttgttaattgagttgctcttcttgataaactcagcgtgtgattcaataaatctcataaggtagtcctcgccgcattgaatttctcttaaataattgaaaacaaatggataaatgccaatatcaaaagaaaaagttttgacaatggactcttctagaattttcataataacttcattatctttcaattgtaaagaataatctaacaaagaggtcgtaatggagtcaacaccgattggatgcagtaagtaatctgataatttttgtttttttaatggagacaaatttctttccataggaaaaatatagtcatatattttcttagtcaaattccaatcttggaaactgtttgccatgaaaaccaaataaaattcgtaagagaactcaggtatccaatctaacttatggaatttaaaccatatttcataagcatttgaaggatctaccttactcatcgaaattaagaaactcgatagcaataaagaaatattggaagcgagaccatttgagctttgaattttggaaactaaatcgtccaaaagattggtagccagttcaacttcgccagtttcaataaaactagaaagaatcacgctgtaaatttcaaactggtcatcaaataagccttggtccggactgccagatgacaaagatagtctgaaatcttcataaagttctttaatggcaaacttatcatttgttaatttagcgtatgagaagcatgcaatgaagtaaaaagaatctttgataaaggcaggtgaagatttgataacttgttgggcttttgacagggtgatatggcccggatagatgttcatcgctaaaaggttatagtcgagaacatctttggaaaaattgcgaaacttaaccacacttttttgccttggatcgttggtggtggtattgaataattcaatggcaattttgtaaaaatcattaccgtttcgatttttgaactgataggccaaaattgagcccttgaaaagagacaatagtacaatattataaatctcatcaggaggttttaatctattgttgatcatatcttggtagcacgtcaagagttcgtacattttgttgtctaaatcattgttatctagcggccttttgcaaagagagtccaaaaccttcgtaaatatttccagtggcggaacgatatcatttcttttcaatgattgatataaagagttgattttgttataatttttttgttcgtaacaacgattaatttcatcaatatgagtttgcaagtatgtagatttattcaggcatggttctgtgtcctccttccaaactggagcgttttcgtcttttagaaggctgtactcattttgtggctgttgtactgatggttgtgatgtttttaatgatagatcttggaagttcctattactaaagtttaaggggtcatattggtttgttggtaatgtggggccggtagaataatacctatgttgattgttgttgttgttattaacatagtttatactttgctgctgcttcagcgatcgaagggaaacgttttggttataaagtagttcttcgtgggtgagggggttgttagtgttgtttatgctagaatccaggtcgtgcggatgcaaaatatcatctacgttgttatagtttacattcgctactacgaccggatgaggatgtagatgagatgcatgaagtacgggatccgaatttaccaaaccttggttttgccttagatactggtaggagctatcgaaaaaagatgttgcagttttcttttgagcggcggaacgatgataacctttagagtatatgaatgatttgaaagccattttcgtttgtgtatgcttgttttttcttttctgtttgttgtggtctctataaatttaaatgcacttatctttttatgcaaaaaaagctgggcgagttatttctttctatatttgtataatttttttttttttgtggagatgaatataaactgacaaaaaattgtgtcagagttgaagctatagctccttttatgatgtgtcgtggttctttgggtgcgatattagggaaacaacgcacagcaaattttcttctgctttcttataacgttataaacaatcctgttgtcttggtttattatgtggaaaacttttcacggatcaattttataaagcatacaactaaagagaaaagtgcagtatggacgaacgagagacaacttaatccatggatttgtaattgacgtgtgtatgattcgaggaaaactgacagtgtttgctttgtcatgggggaattgtaaggcacaccgagtctcggccccgagtgcctggccaatgagaacgcgcgcattcggagctgccccactttttgtgcgctcttgcatttcattggttagccggaggaattcggcggttaaaagcggactcgagcggaaataaagtctttgcttattgtatgccaggaaaagctctacaaatctactaaaagagtcaaatatacagctttgccaagcgtgcggcatagggaataacaacaaattggaaatgtgcggctagcgtagtcttggtatctactaccgactctgaagagtttagcgagctctcagacggttttttctcttttggcattttattcaggtggcctcagatgttaaattttccatggcatcttgcgtaaagcctgctaggttccttgccacatataattgcaccgcgaattctgtgataaatatattgtaagattttctgttgtcttggaattgctctctctttaaataatgctttatatgtttaccccaattctttgccgccgaaaggtcagcgttgcattacgtggtgtccggtccctatttcctgggttttctgcggcagattcgcactgcgcgccacagctgtaacaactgcagtgttatttcgggtgccaatttagcgtgcttcgatctaactattctgtaaattctgtagtgactctttagggcgaagtacgtatttcatgatttaaagtccccgtcttcaaatataccgaaaaaagaaacaagacattttttagcagtttatgtacgcattttaaaacccgggaaatgcttcttgttaccccttttggcgctttggataagtagttcacttagctatttttttttccggttcgaactcggggtgaggctttatcatgcacttttttttggctattattaattttcgcagccttaatttttccctttccattttctcgcatgtggcggttttcagtattacttagagatgccttaaataaatctaacaggcaggtataccaggtacgagttaaaaacctttatcaggtggccgacattagggaataagacagcatggagcggcctggcttggtattgcaggaccttccacccgaaatcctgataaacatcttttctcacttagacgaaaaggacttgttcacgttgcaagaactttctacgcatttccggaacttaattcacgatgaagaactttggaagaatctgtttaagtctagagttcacacgactcatttccccacattttctcagtcttcgaaatttagtgtagagtatattgaaaggacacggggtcttcatcattggcagcataacaaggctataagaaccaaatacacaataattccgacaagaaactgggatcagcccagtatagaacgcatagtgtttgattatccacgagttgcagcttataatgatggtaccattacaattttacagttacaaaatcacaaaaggcagaagaaatttaagaaattgatttatattccatgtacaacaccacaaggttgttctaccatggacttcaatattaatgctgcagtgtttggtaggtttgacggcagagtgtttggaaaactgctaagtaacaaatcgtacttaacgcccgtgatggaatttacgggaaggcatagtgcaggcgttactgccatttgtaattcagaatcctgggacacgtcaagagaggactggtctgttagtggctctgaaaacggtgaaattatatggtggtgcgaaaataagcttgttaagatgtggaaggtttctaatagggtaatttggaaactggctttttttaaagattggaccttaattatggatgatgaaaagctgtacattatccatcaaattcaggaattgcacagtattgatattcctaaggatctggacgaacagcctatgagggtacggtttttcaagatggatttcggttccatgactttggtacttgctgacctgaataacgtttatacaatatcggtcaatcccaatggtaacttcggcaatttgagaaagttggagatgcctgaacaaatatgcgcagttgaaatagatgaaaaaacttctcaaagggaacaaaactggcaatttgctggtgatgacggctgctatatcagtcttttgacgacacagaacactttatacattatcaatataagagatctttcttcgtcaggcttaaaagttcaatgtaagataagttttgatgagcaggtatacgtatcgcaggtgacaaatttaatagttgtggtagcattgccaaatgttcttcaaatattgaacgcgatgacaggcgagttaataaagacagtgttgaaaaccgagaagtttcccgaatttttgaaggtatcgcaggataaaatcattatgggaagcggtaatgttttgaattatttaaagtttgtttcaagtgattcaaagaaacatcaccattccactaaaggtaaaaacacagtaagcaataagtggaatgaaactttgaacacggagctgcaatattatgatgaagatgaagaccttagaagaaaaagacagtcagaaatatcaagattgatcgatgcgtatggtggagaccttgaactttcaggcgacaccgatgaagaaaacgacattcagttgagaattgcactcttagaatcacaggaggcgcaagcacggaatcaagctgaagcgggggagcctgtcggagatgatgaagatgagcagttaagaagggcgctggaggaatctcaactgatatatgagacgcaaacgaatagctctgcgaatcatggtaatagtacgaatgatgagatagacgaagatgatgaagagtttctcagagccatcagacaatcaagagtggaggacgaaaggagaagacatcttagaaatcatactacaggtcgacgaaatgggcccttgagcgacgataattttgctacatatggtgcagcagagtcatccgaacgaacctcaactgagaacactatcggtagttctgttggcgttgatgctagtaataatgttgatgaagacttacaattggccattgcgttgtcattgagtgaaatcaattgaaagtatgtacatttggaagagcatatgttaaatattttatttatagatttttcgttgtgaaatattattttttttttgtaaaaaaatgtcggactttattcctcctaattattaataaaatacgaatatatatctaaatataattaatgcttatttacatgaaaaatcatcaatcgtaaacagttgattaaaaaacaaaaactttatcggttccattacctttgtgaaacccattactccaccccaactcctttgcataattcaaaaccatttcattcattttaggtggtccgcaaatcaataaacgatggtcctccgcttgtttaggcaggtatcttttcatttcctctagagttacgtacccaacatcaccgttccatttaccgtttggcttatgaattacataatgaactttaaaatgcgggtactccttagccatgtggtctagttgtgatttcatgagaatgtcatcctctgtttcgtttgcgtatatcaaagaaatgtgtgttaggtcttctggagagggtatgatttcttgcagcacttgcaatacaggggttataccagacccccctgcgattatacccaactctgttgcggtgtcctgatcatattccagctcacctaacggccctttaaattcaacatactggccaatttttaatttatcaaaatacttagaaacgacaccatgtttatacgtcttgactactaattccaagtgaccctccgtgttaggaacatttactggcgtatagtacctcactaatcgctcaccatttattgtaacccttactgccaggtggtatcccatgggaatatgcaatctttcaaatgggtactttaacttgaagcagtacagactagtattacgagaaatgcgggtcttcttggatagcggtagcgcgacccatttatttctgtaaagagatttatcagttccaatcgaaataaacgctgtggcataaagtattacgaattgcagcaatgaaacgaccacgattctaccattttgcgttttccaaaagtaaagaggtgtaaccacacaattcagaagcaatccagtacaaaatggataaaacggatttgtcgaaacaaacgatatgcatgtctctactatcgacattgttgcgaatggttgctttttacaaagaaaaaatgtgatatgagttaatactaaacatacttaaatcctagagagaaaaaaagtactgcaatatatacagcactcaaaatacatttctatctgatttctaaaaacttccctgtagatggatctacgttacgccatgccgatgtttcgtttttgcttatacgaccaatcattaccgcgttcggcttttccaaaaaaaaaaactatagtaaggataatgaaaagaaaaaagggtcccatgattactaaaaagctctaattcaaaaaaaaagtctttgataggcagctaggaatagttattagaatgtacatgaacagtcatcacactgctatatatatatatattcttttttagtaaaatatagagattattgagacaaaaagagactagtcggacaactcactaggatctataataccatttatgatagcccactgtttgtttgccaagaatacattatcgggatcttgctcctttcttattttccggaactttttcaaatcctcgccataccattcttcaaccttcaatgccatccccctcatttcaaagtcatcgtaatcagtatcctttttcactggtccagcagctagagtggttgagcctaggaagttcttggcccaatgtggcttacctcccgctaccatcatagtattttcaaaaagggtaaaccatttatgaattggagtattacagccaaacggcctataaatggtagcatttatgtacaacgtcaactgactgttggtaacattttccaacggagcaaatctgcaatgggatggtgtgttatccaggaatgggcggcacacattgccataaacgggaccgggactggtgtttgttctcttgctagtatccaagggttcagaaggtaatgtagtatttgagcaacggacttccataggcacgtggacataaaattctttgtttatggcagcctgcgcaatagaatgatccaatgaacgtaagacttccaaaccattatccatagggcacccccattcatcaacaaattgtgaaaacaaacagtccatattaaatccgctgatagaatcggtaacattaacatcaccagtagagctcttctccaatttcccatattgcctgttgaaaacgaacttttccacaaatggggttaatggcgcatagattttggtagagatccataatagagtttcgtagaaaaatctacccagcttggtaccccaccatgacttggctggaccattttgggcatctgtagttttgttacccctccatagaacacattttctagtataagggtaccaccaaactctgataaattcagatgaagtccatagggtatcccattgcttcaaaaggttttcaaaagtaatcacttcttgagtggatttaatattgaagccgggaacaaccctgatagtagcagagacaatgataccaatttttccaactgaaagtaaagcagctttaaagacttctggatcgttttcggcatccaagaacttcaattcgcccttaccattaacaatagtcaagtttacgtattgagaagaaatcaaaccgtgataaggtgaggaaccatgactaccagtagagattatgccagcaacactttgttctgagatagagcctaaattttggatagagtaacctttcgcacccaaaaattcattcaattggtaaagcctcataccggcatcaactgtgacatcggcataatgtaactcaggatattcaacaaacttttgtactttgtccaatctgtctaagttaacaagccattcatcagtaacgcacatgttactaggagaatggcccgaaccaacagtaactaagcttttttcagctagcctggcactctttactaactcgacaacctcatcaattgaacttggttggaagtaacgttctggttttgcagaataaattccggcccagtttttgaacacatagttctttctaaatgggatagtagacatggggtgaaaaacctgataatatcggtaactttaattttacgggttcttgttttaccttctaatgaattttaagttttgaaaagcagaaaatcagatattgaaactatagatctgcttaccttgaagttcactatttttggaattctccttgctaatagttacttctactcttgctttgtcctggatatcaatggaagatgtcctcatttccattttttttttcaattcgacggcaaggcgggagaaaaggaactagggatacaaaaatgcaattactaatgaaatccgtgaaataatcatggaaatgggtgatgtaaggatctgatgaaacaagtacaaatgtctttggcccatcaactacgatgagacttactaagctttcatcaaatgcaggttagagaaggagaatggtttttttttttattttttgtacatagatattagagaagtataataagtagattatagataagatatcaccaaagagatataacagtagggggaatttttttttttacaatatacttgaaatatagaaaggataaggaggttgggggcgagagtgaaccttaaaattcctcttcctcagcgtatgagtcggcacccacttcgatgtaatctctttctaaagcagccaaatcttctctagcttcggtgaattcaccttcttccataccttcaccgacataccagtggacgaaagcacgtttggcatacattaaatcgaattttctatcgattctcttccaagcctcagcaatggatgtggtatttgacaacatacagacggccctatccacagtggccaattgtgagtttggtgtggcagttggaggttcgtagcaaataccgatcttgaaaccagttggacaccaatcaaccaattggacggtcttcttgtttttcacctgctcgacagctctttgaacatctcttgttaccacatcacccctgtataacagacaagtagccatgtatttaccatctcttggatcacacttgaccatctggttaccaggttcaaaacaagcgtttgtaatttctgacacagagttggactcatggaatgcctttgatttggataagactggagaatatgaaactaaggggaaatgaattcttggatatggaaccaaattggtttgaaattcgttcaaatctacatttaatgaaccgtcgaatctcaatgatgctgtaacagatgataccacttgagcaattaggttgtttaagtttgcaaagcttggtcttgggatatccaagtttcttttgcacatgtcgtaaatagcctcattatcgaccatgaaagtacaatctgcatgttccaatgtagtatgtgtagttaaaactgtgttgtaaggctcaaccacagaagtagacacttgtggagcagggtatacggcaaattccagcttggatttcttaccgtattcagcggatagttcttccaacagtaaggaccctagaccggaaccagtaccaccaccaagagaatgggtaaacaagaacccttgtaacccatcacattggtctgccagttttctaatcctatccagaacatcgcccagaatttctctaccaacggtgtaatggcctcttgcataattattagccgcgtcctccttaccactgatcaactgttctggatggaacaagtccttgtaaggaccgttacggacttcgtcaataacgttgggctctaaatccacgtaaatagcccttggaacgaacttaccgtagccggtttcatggaaaaacgtggagaaaccctcttctcctcccttcggctttgaaaggccatcttctagatgtccatccggcttaataccgtgctcaagggaatataattcccaacaggcattaccaatctgacaaccagcttgaccgactgtaaagagaaatcaaaaaaaaaaaaaattttgcgttgaagttagtaatgaaagatgaaacgccaaaatgaactaacaaaaaaaagatctagcctggacgggcaaatagaacataccattaatactaataacttctctcattgtttgtttgcagttgtaagtttacagatcttgggtggcgagaactgttgtagacggatatactgaattgggtaaaacgatatagtagatgtttttgttttgttttgttttgttttgtagtttagtttttcccttggctcgaggcgttttcgcgtggcataacccggccggaaactacagtgatactatcgtctggcacatatatatatatgtaaactatacttatattaatagtttccgatcgtcttattactcacttactatcaatgaaagcactatttcattacttaaaaaatactttctattgcagaatctgaaacagtcagttataatggaaaaagtatgcaattgtgttttcttaaagaaggatacagatatttatatatgttagttcctctggaatatatcgctagatgcattaaacatgaagaaatttgccgtatgaattattcctgtatgtacaccaaatgtgtcatgatcttcttgtttcttcaatgtggcgctggcattcgagagtgatgatgcttggtgtgagcacttgaaatgtctcctctttaagaaagacaatcctatcctttcatgatcaagggcttctagggcgtctctcaatgccaatttcaaatcggtagggtctgacacggtctggtggcatttattaatgcagtgggtaaggaagagggagggcttgatgatgtggttggctgaaatcggatggcagtgcccgccattgatagactcaaattttactgtcttcgtacagtggttgaaggtcagtatgagttttgactcgcagatcaaatggattttgtacttttcaggagtccttgttctttgtatacgcttattgctgagttgctcgtgaacattcatctcacaaacgagttcgtacttgttcttattgattttctttgtcctgtagatgaaactaatgaatgaatatactctaacgaactgctcaaacgacagggtacataggaactcgaaggaggattttggatgcttgaaaataaagtccctgaagtttagaatgttgttgatattttcgatctcatccttgtttactggatggtgatattcctgtgcgcatgcaattagttgtttaccagacctaactttgctcaattgtgcctttgtttttgcacaatcaatgtagttaggaatcttcctaattaattcctcggtactatctcgctcaacatcacggccgccgccattcccgatcacaattttgggcaggataggatgtgaaactctgtcctctactgtgctgggcacaggcgacggtggtagtttcaaatctggcagctttatggcgaccggggccaaagggggtgagggagccgttgcttcaaactgaggtcttggggaggtcataggtgtgataataggcatcattgcggcatgatttcgtacagcgacagggatagtgacaacctgttgtgaccaatggacgggcgtatttgtgctcatagaaggcaatatgggtgttggcaagcacctggggctggagtacccaaatgtcagcgaatgttgttgatctaacgccaatatgattgggggcagaacgggcgataggcactgcctgcctggaggtgttctgggaacgtgcgcctggttgttgttatatacatgtaaatagtccattgagtctttaccaggttctatcttaactaaagaactacttctacacaagacttaaggcaccttcatacgaaaaccctctccacgatggcgttcaatctttcgtctttatatacatatgttactttatatatttatatatttacgtatacacccgaatgtatttatatatttgtatgcatatgcccacacgtatatgctcaagagtaaattctccgacccgtttaaaagcaagcacacgtcaaggtttgctgtctccactcgattcgtaccgttcctgcggtactcctaggcaagcagttaggccctgccattcacccactcaacagttttaacagtatacgactgcaaggccatcgtttaccggcagggtctattgttctgcgcgttccttattaggcaccgccaaaaaaacccttgatattttcgtttaggtgccggctcgttaagggcccttttgctctcgcataacgcaggcacaggtcacgaactgcggtgcggataccctcgatttaaagacaggcagcaggtgaagataataccatgctcaacatggacgccaaggatagacgtgtaagtttaagtttctctcgttgtatcgactgacctctttaatagcagtccttaccaagttgaaaaaccacatcttcgtgttacccgactacctgcgcgatgccgtctggaaaattcgcaatgaaaatttgatgaaaaaattgcctctcaatagtgaaagaagtatagcagggccacgcagagagtaagggctataggcgaagttttcctgacattttcttcttctataggacattataatatggtttcagcgcaagtggctaccgagctaggacagcctataccactggacactcaacatgcggtatctgtatgtttcccgacatggaaatctgtaatttcgtatgtggagaaagaccccaaagttttagggtgtttaaagtctggctaccccaggttttggatccacccctcgattcaaaagctgcgtgatattttaatagaaaagtatgctaaagaaaacgaaacgtgcttttgcttcccgtcttatagagttgccaaacggtgcagagagtatgtaagaaggaagtgcgcgcatcgcaatggcaaagtaaggatattacagttagccacggcgaaacctatcaacgaggagcagaagacgtggaaaagagagtgtaagattgcggtagtgtttgtagatggggcgtacgagaatatattaaaacagtattggcaatacaccggagagatcatctcaagcagactagctgaatatgttttgcatgaacttttcatggtagaaaagaaatccagccctgcagaggaaaaggaatacatagagatgcggtatggcaggaatctgaattttgcatttgccgatcgagccaaggaattgattaagaagaggatcgctacaaaggttatagataaagatgagcacgatgaggaggaaaactaccatttcttagcaggtaaccaagatgaacaggacttccaggacacgtttctggattcatccctcaatgaggctaaccacggagaagatcatgacggcgggattagcggtgaagtagacagtcaagaagaaccgcataatggccttgtttccactatacccccggagcccatcgaaatgagcacgatagaggaagagcaatccgtagaggaagatgccgggaggtgtgcattgagggtttgccctgagagagacgtttttttgtttccgagcggcatggcgtcgatattcactgcgcatagattgctgttgcaatgggactcactgcgtttgaatagatccagaaatggaagcgacgtcacctcgtcacctccgaataagaagaccgtgatttttgggttcccttatgcggatacattacatgtcttgcaagagtttaatgaaacgtatttcttgggagaaggagatgagtcttcaatgaaagaactaacaaaaattttacattccggggagcaaattcttgccgtttttatagagaccccatcaaacccactattaaaaatgggaaatttactggaactgaaaaggctttcggaattatttgggtttttcattatcattgatgaaactgtgggtggaatagttaatattgacggtctaccgtttgctgatatcgtttgcagttcattgacgaagacatttagtggggactctaacgtcattggtggttcaatggttttaaatccacaaagccgggtatacgagtttgcctcccgttttatgcaattagaagacgaatatgaagatttattatggtgcgaagacgcaatttacctggaaagaaattccagagatttcattgctagaaccatcaggatcaactacagcaccgaatacctcttagataaaatactgaagccacacgtaggcgaaaataaactattcaagaaaatctactaccctaatctaacctcaaaagaaacactaaccaactatgacatggtgaggtgtaagaaagaaggtggatacggcgggctcttttcactaacgttccatgacgaagatcatgctgcggccttttatgacaatctaaagctgaacaagggtccttccttgggcacaaatttcacactcgcattcccctatacgctcatgacatactaccacgaactcgacatggctgaaaaatttggggttgagagaaatcttctcagaatcagcgtaggcctcgaaagtcagtcaatattgggcaagatcttccaagaggcaattgataaaacggtagaaatatgataaaagaaggaagataggcatagtgaattttatttctaatttcactttttatgttttttttttcgatatttaattttttcacgcattacgaatatatttctatatacaaacatatgtagtagtactagtagctgtcatcatcacctacaaatgtgtttgtcctagcattattcaatcaacttccacaaactttccaccttttgcgaatctgggatttcttggatcattgataaattccttcgtgttagaagaaaggtcagcagctttactcataccataatacactgcggcgccagccacaaagaaaggccagtatactttaaggataggggtagggaatcttttcaacatggcagtacaatccaatcaattaatctgtcgtcgtatgttaaactaacgatatctgagtcgaactcttctcaacacatctcagctgatcgttccttatattttctctaggcctttttaaaccctcggagatttatccgtgtaaagccgcattgtttgaccttattgggtcgttaagagtgatacatgatttattggatgtttttttggccaagttttgattattaacctttcgtgttattattgcacgattaagtacaatagattaatgttggtatactttggttgtggctgctttgaatacttttagttttgttgttataacaactatcattgcacggaatcgcagctattttaaatccgggtaatggctcgttcatagtggcttaatctttttttttgctgaaaaacccgtagattattaacaatgatgaatggataaacgccattgtttggtctcaataaagtggtcgtattgggttattctggtcatactggtggttaaatcgactgtcggaaagcaccacggataccctgggtaaaataaaagcccagttgtcttctgttctatcagcagcgaatatttcagcttcttgtaattgtacgttgcatctgccatgtcatcggaagaattcaaaggacttccgatcaaacgagatatatcctccactatctatgctgatagacctccagcattatctgctcctccgtgcgttggtgctactgggaatgataaaatacaagtactaccgatccccaagaaatctaggactatcaaaaccgataagccaagacctttcctatgccacatctgtacaagggggttcgtgagacaagagcatttaaaacgacatcaaagagcacatacgaacgagaaaccctttctctgtgtcttttgcggaaggtgttttgcaagaagggatctggttttgcggcatcaacataaactacactcagcactggtttctaaagaatctataaactctaaggataaaactgaaatagatgctatcaatgataagaatataattcagattcaaggcaataagcaaacaattttaccaacgcctagcaatccgctagcaaagacggcagcacagttgaaaaaagccgccaaagagaaaaaaaatggtaagcaaggcaaattagacctgagtccttcatacggggcaaataatcatagtacagacgtttcaccgtcagtggggaactcatcaacacctgctgtaatcgaagagacagactcgtcttcccattttccgcttccagatacaaatattccgaccaaatcaaagaggcatgcatcattttcggcatctagcgcattcacatatagttcagataactttcaaaagctacatcaacaagcaaaatcggattttgatgaactacaggaaagtatccctcaccaagtgggattttctacaccccaattaacggcacaacaacttatagaaaatgctattgaatctggtgttgtggacttggaaactttggatttaccgccatttttatcgttagatggcttaccacccgcgagctcaagtgctgctgtagcagcatccgagcagatagatatctgtccctcctctgcgacagacactatctctggcgctaacagtactccaaaccaagcagcaacagctcctccttttcaattaccaatagcaagggaaagcagttccttgtttttggcaaataccccttatttatctgactttttaacaatgggatcttcctatggtggttctggagggtttgccaaatctatcactgctgatcccagtttggactatttcaactacaaaaaccattcgcatccagattcaaggcataacaacagctccagcggtatcaattatagcaataataaaaacaacaatgaatcaattgaaaaatctcaaaacaacagtaacgtaatcaatgaaactattgaccacactgacatccatgcccatcacgcggatgctcatgatgactccttcatagaaagtgaagagtggctctctaagtttattatggactctcagattgataatgatcttaaacttaatataaaccattttaacgatattgggtttaacaatttgcaccctcaaaatcctacgacccattctgaaccaagaaatatgcataatgaaaacagagatatgcaccgatctgcaagcaaatttcaatctgtatcggaaaacatctctccaagggaacaaatgtctttgtttaaaactaaacagaacaaggccatttcaaaatttctgtctgacgagaaaattccttcaactgcgtcaccatcttcctctgcttcgccagttcagtttgataaaaaaaatgttgacatcaatgaatttttactggacgagtccgtgtccaacttattcacgactaggcaaattgatttattcaagaaaaatgtgaacttatattcaccactatttcaaaatcaaaaagacgcagtctcatctacaagcctgacgccatcgttgactacacaaactgcaacgacacaatcggggccagggtggacagattcctcccaaaagctgactttctttacagaacagttgagaaatttaattattaaagaaaacaatctaaagtctaatctctttcccactgttgatgaactgaatcattatgtcgatttatatcaagtggaatttcataaatatttcccctttattcatttatactcaattataccatccagtgaaaactatcctttagtaatatccatcagtatgattggtgctctttacggatttcattccacacatgcactactattgtcgaaaatagcaaggacgagagttagaatgttcctagaaaatactcgaagcaatcatgataagacaccaatttggctaatgcaatctttagtcttattaacgtttaccagcattttctccaatgatatgaatgcctttagaaccgtgaatacccagataatgattttggttcagttgattaaaatttcaaagttgaattacccattagaaaacttcattaagccaccgatcgaaagtgaccatgttttagaatatcaagataaccccgctgttttgaaccagttcaaggctcaatacaatacccgtgaacaaataaacagaaatttcaaatattttatcttagcacaatcaagaataagaatatgccacatagtcctgctgatttctaacctctttaaatccttagtggatttcgattgttgttttcattccatagatttgaagtgtggtgttccttgttacaacgaggtactgttcttttgcgaaaattcaagaacttggaatgagaacttgacgagattcaatatcgttttggattccaagttttccctaattgaagtatctaatggtgaatcaaactacgagaagtgcttgatgtatttgtcaaacggtaatccttatctttataaaaacgctaaaatctcattcaagactttgctatctttactgatctctattcatgaaaagataaacatcgaaagagatgcgttgaaagatagttacgaaagcgatttccatgcgaagaatgttcagtggcggatgcattcaagacccttggtcgccacaatgctaaaacattgggaactactttacatcaaaaatggtgggatattggctctcagtgacgaaaacctgccaataataaatactaatccgtcgtttagattgataattcccttgtacttctttgcaaagctaaggaagtgccttgatattgctccaacactaagatgcatttggaaccaagactggaactcaatgaatagctctttagaaaaagtgtgctacgagcgggaatcactacgagaggccacagagtacgctgtatccgttatcactttctggattgatactgtctctgtaatgaagggtaaatcgacacagactccaatcttcaccattacttgtatttttgtttcgatattggtcatagcggggtacatgaggagattggaagactttgctcaaaacaaaaacagtgattgtatgattggtagtttaaaaagcactgacaggatcttgtggttaaaagcattcaaaactttgaagaggatcgaatcacatttatctgaaagagagtataaattacaaacatttgctgagtttttaagggttccagataatggcagtcttgatattgagagtttggactcatccttaatagagaatactttgaattcacatgatgttaccaatcaagcgctggacataatcacgagaacaagattgtcatcaagaacattgtattgcggtgctagaattcttggcgatacaccagtctggcccgtatctctgttgtttgctcatgccttacaatctagggctatttacaatatcaaccacaggaaatctgtaaacagtgtatagactttagatagatatttagcatatccgtatgtaacattatattagttctttagggcaaattgaaaaatttaatcatcttttcttattcttaaaagcgtgaaaatcaaaaaaaaaaatcgatgagttgagaacatatgataaataaaaacaagcaaggtgatcgtcaaactgcactcacgcacacatagatttttagctcccaaagtgctatcgtctatactatccaagtttttacaggctcgcaataagctcaataaacaatatcaactgcatatgactgaacctgccctgagtagcgctaataacgctctgatgcaaaaactaacaggtcgacaactttttgacaagatcggccgtcctactaggatcgttgcaccaatggtagaccaatccgaattagcatggcgtattctatcgagaagatacggtgcaaccttggcgtacactcccatgttacatgcaaaattatttgctacctcgaagaaatatagagaagataattggtcttccttagacggctctagcgtagataggccgttggttgtacagttctgcgctaatgacccagagtatctattggcggcagctaaactggtggaagataaatgcgatgcggtagatttgaatttgggctgtcctcaaggcatagctaagaaaggtcactatgggtcatttttgatggaagaatgggaccttatacacaatttaatcaacaccttgcacaaaaatttgaaagttccagttacagcaaaaatacgtatatttgacgactgtgaaaagagtttgaattacgccaagatggtgctggatgctggagctcaatttttaaccgtccatgggagaataagagagcaaaaaggacaaaaaactggtttagctaactgggaaacaatcaaatacctaagagataatttacctaaagaaaccgtgttttttgctaacgggaatatcttatatcctgaagatatttcacgttgtatggaacatatcggtgctgacgcagtgatgagtgctgaggggaacttatacaatcctggtgttttcaatgtaggccaaactaagaacaaggagaagatatttccacgcgtagataagattatcagagagtatttccagattgtcaaagaatgccaggaatctaaagcctccaagacagcaatgaaatcacatttttttaagattttaaggcctttcttgccgcatcatactgatattaggtcaacacttgctactatgaatgcaaaagccacgtgggaagaatgggaggaacaagtagtgaagcctgtcgaaaaagtagtgcaagaaatatttgaacagccagatatcgatattaaggatgaaattactatcggcgaaaagcaatcatggggtggttcatatagaactgttccatactggagatgtcaaccatattttaggcctgttaacggtatcacaggtgataaaagagttatgcaaggcctcatagatgaaagcgtgaacaagaaacgtaaagctgacgtgccattagaatctgctgataaaaagaaggacgtgaaagcttaaaacctgataaaatccatgtatatttctttgccttttctattcttttctctaagtatagtttttatgtatgtatattaattcaaacagaaaatgttcaactccgtctccataagaaaacttctttcaatttgaacacttgtatattcaatcagaattcgccatagagagcatgtcagccaatgtacaagaagctgcaaatgcagctatagagccggccagtttcgttaaagtcccaatgcctgagccaccaagtagtttgcaacaattgatcaatgattggcaattaatcaagcatagagaaggtgggtattttaaggaaacagataggtctccctacaccatggaagtagaaaaaccagtaaatggaggctcaggtaatactgaaatggtaacaagaaatcaatctacgttgatctattatctactaacccccgacagcccaattgggaaatttcataagaatattaacaggatcatacatatcttacaaagaggcaagggtcaatacgttctagtatatcctgatggtcaagtgaagtcatttaaagttggttttgactataagaatggagaagtctcgcaatgggttgtccccggaggtgtgtttaaggcaagtttccttctgccaaacgaagaatttgacaacggtttcttgattagtgaagtagtggtaccaggttttgactttgaggaccataccttcttgaagggtgaagatgaactgaaacaccttgtgggacctgaaaaggcagctgagttagcttttttagcttgaacttttgtacttagttattatcaaaataaccaataagaattattttagtcctttcgcaccgcgattattaataaactcaatatttttttcctatttaattccataaagaaacaaaaaaaaacaatcaggcaaaagcaagcaactacaaaggtctacttaccatgtttaaacgttccatcattcaacagtcccgcttattctccaattctgcttctagactaggtaaaaaagtgttctttgatcctgcggtcaatggaaccaaaatcggcagaatagaatttgaattatatgataatgtggttcctaaaactgctgaaaatttcagagccttatgtaccggcgaaaagggctggggctataaaggtgtccctttccacagaatcatcccagacttcatgatccaaggtggtgacactgatttgactaacggttttgggggcaaatccatttacggttccaagttcgctgacgaaaattttgtcaaaaagcatgacaaggcaggtttgttatctatggcaaatgctggaccaaacactaacggttctcaattcttcattaccactgtgccttgtccatggttggatggaaaacacgttgtctttggtgaggtaaccaaaggtatggacattgtcaaagcaatcgaatcatacggtactgcttctggtaaaccaagagctgaaatcgttatcgaagaagctggtgagttatgaaggcttatatgaagctaaggtctctcatatttctagcatataaggtatgcgttatctctatgtctacgaactatatctgtttatagtgttttattttatatagactcgctggctcataaaaaatcaaccaacttttattctggtttgcctcagtcgaaatgttgtcctttactattgactagtgttgaagaatttccggatcttatattttcgacaattgagttccaacatacattacagaaaaaatacaaaaaaaaaaatacagaactatcgtaagataatctgcttttgatataaatcataaatcagtggagcatggggatatattcattttggatctttgataggcattgtaactgcatatttgatagagaatggacattggcgtccaatagcgcaagtggtacaataaactccaaacagaatgaagaagatgcaaaacttctgtatggtatgatattttcgttacgctccattacacaaaagctctccaaagggtctgttaaaaatgacatacggagtatatctacaggaaagtatagagtccacacatactgtacagcttcagggctatggtttgttctattgtccgactttaaacagcagtcttacactcaggttttacagtatatttacagccatatttatgtcaaatacgtgagcaacaacttattatcaccgtacgatttcgctgaaaacgaaaatgaaatgagaggtcaagggacaagaaagatcaccaatagaaactttatatccgttctcgagtcatttctagcaccaatggttaatcagtgagcacgaaccatgagcagaagaaaaacctaaaataaatagaagcgatgaattgaattgcattcatcgtatatatacctaaggataaattaattagttttacatattttaaactttgtttgttaatacaaactcggatctggtttgggtcataatttttgttgtgggggctcaaatatcattcatgaaaaggtctgtccaaaactcgtcatttaatgaattaacgccccatgctaaggagtttatatccgtcaaataatcgttcaagttgtctaccgatgaactaggtgatggttttatattagttgagtcagcagagttagtcacaccattagaaataaatggaggtggtaatagagttgtgcctgtcatactctctcggtgttcatgtggggattcattcatatatgaagtactgttaatattcaggttcattgcggcagtatcgtcacgaactcttgagtatactggcagcatttcatcaggtacagcggctatgttttggtttgtattattgtcgataattggatcttcttctgttggcatcttttgtgactcggttacatatgcatttattggcttcgtaccatcgtggccattgcttacttcgtctatgacctgcttttcctttagtttctccctttctgcattgtagcgatcagcaacatcaataactttgtttgcgtaggtttgacaaaataacgcaataacatacctaaatttgtaaagagagttgttgaagggatacaactctgatgttttttctaaaagattgttcacccctattaccaaggcaatagcatcatctgtaaggggcattaaatcgtgaaacgaaggaatagcgactacggaatagcgcagctttaataagagcataccaacggtatatatgatcctggaagtatgaaataaaggtaatgaggtaattaaaattggctccaacttggaaaattcctcaagggcagatttacagcaatgatagcatttaacaaaatcatccattatttctctgggcaattcgactttttcgtttatggtatgcgacatttccccgatgaatactgcaagtttatactggtataaataagcttctacagagtaataaaatgcaatcactcttggcctgtttctgtcaagtttagtgaaaatctcttgcaattgcttgtggtatttttccattagtttattaagatactttttagtaaaaataggatcatcaaactcgtcatcattcagatctctctcatgtaggtgtgtgtgaatattttccaagacgtggttcattttagcaaattgaactaagatgggatcatcagctgaatcaagtaatagtttatcgttgtcataatgtcgcgattttttcgtctctttaactaaatcctcgcaggccttttccgtgacgtgactccaacgagcttgtattgattgacgtagaaaaattgaaatattgagtgcggaaatgtataccaataaagttaaactggcgccattactgtaaagttccaaaggtgacttgaatctctttggatcctcgtcactaaacataccaaaggatcgattgacataggtaggccccaaatctctagttaaacagcaacagatgtaattaaatatatggtatctcgttttacttgaccattcaaaaaaattataccatagacataatgtagacagtgattcgatgatttcgatagatttattattagccttgaaaatctgatttgtaattaagtttagtacaaaactatcaagcttcataatagttcctctggtggtttgtttgggtgttagtacaattgaaacacatgacataatgacggagaataaaataggtttcttctttcttaattcatcgacactaacattctcttcgacctttatgaatggtaattttgacaaatatgaaatctcggttttataaagatgtaagcgaagcgtcgcttcttcatgagatatgattcccactgacacaggatctgcaatggttggcaaaaacatgctcttttcaacaaggtcattccactgctttgaccaagtgtcaagcttcatcgaaatatctctaattttacctttttgagaaataatcagtgattgtagctgcttcctgaacgaccgtgtcatatgtctagagtatgatttcttttgtcttttcactttgacgttctgtgtttcctcatcacccacaattttaggtctatgtttgaacagtgcttcgctgttaatgctggtaggcgcagatgaaatcggtacgggggagttgtaggtactgtatataactggcgcatcactaatattagtatgctcatcgttagatgctaaaactgctggatttgtgggcacactgccattggattttgtatgattattggtggttatctctccggtagatgtggtttcggcctctcttgctccatatgagggtggttggcttaaagttgaccaaagatcggataaactttgttgaagtccaggtaagactgtccgagagtttggaaattgtttagcgtttgggtcagaagggaaactggcgaggtaagatgtaccatccttcaagctagattcttcagaatctgttgggcctttgcttttagtagagacattcaccatcggcgattcaaaagatgtgggtgaccttgatctaggctttctcttccttgtcctttttgaaagatcaaacttgcacagcttcttgtgtttcagacaccttcgacaaggtttcctataaatatcgttaacatcagaaggctcacatttttgcttcaaggaatggcagcatacacaagcaaatgagtttcttttggtcttccccttttcagtagtctctagttttgtaggatacgagagcctagggtcatctttggagcatccttctataatagtttgtgtggccttatctatgcatgggacatccgccttcggcaaagaaactttttggtcggtctttgaattattattattgatttctttcccgacggcaacgccagttattgcaatctgcgtgtccatgttgtaattcaaccctgaagatcttcccgatcacagtcaatacacactagatattaatgtatactgtatgaaaaaattgactttccgcttcattgctcctacatttatcggatggcgtacataactaaaaaaggaagattttcactcataagggaaaggaaccgcatgactcaagagaagcatgtggtttttgagtttttttcgttgaattttcaggtaaagctcaatagttatgacaattacaacaacagaattctttctatatatgcacgaacttgtaatatggaagaaattatgacgtacaaactataaagtaaatattttacgtaacacatggtgctgttgtgcttctttttcaagagaataccaatgacgtatgactaagtttaggatttaatgcaggtgacggacccatctttcaaacgatttatatcagtggcgtccaaattgttaggttttgttggttcagcaggtttcctgttgtgggtcatatgactttgaaccaaatggccggctgctagggcagcacataaggataattcacctgccaagacggcacaggcaactattcttgctaattgacgtgcgttggtaccaggagcggtagcatgtgggcctcttacacctaataagtccaacatggcaccttgtggttctagaacagtaccaccaccgatggtacctacttcgatggatggcatggatacggaaattctcaaatcaccgtccacttctttcatcaatgttatacagttggaactttcgacattttgtgcaggatcttgtcctaatgccaagaaaacagctgtcactaaattagctgcatgtgcgttaaatccaccaacagacccagccattgcagatccaaccaaattcttagcaatgttcaactcaaccaatgcggaaacatcactttttaacacttttctgacaacatcaccaggaatagtagcttctgcgacgacactcttaccacgaccttcgatccagttgatggcagctggttttttgtcggtacagtagttaccagaaacggagacaacctccatatcttcccagccatactcttctaccatttgctttaatgagtattcgacacccttagaaatcatattcatacccattgcgtcaccagtagttgttctaaatctcatgaagagtaaatctcctgctagacaagtttgaatatgttgcagacgtgcaaatcttgatgtagagttaaaagcttttttaattgcgttttgtccctcttctgagtctaaccatatcttacaggcaccagatcttttcaaagttgggaaacggactactgggcctcttgtcataccatccttagttaaaacagttgttgcaccaccgccagcattgattgccttacagccacgcatggcagaagctaccaaacaaccctctgtagttgccattggtatatgataagatgtaccatcgataaccaaggggcctataacaccaacgggcaaaggcatgtaacctataacattttcacaacaagcgccaaatacgcggtcgtagtcataatttttatatggtaaacgatcagatgctaatacaggagcttctgccaaaattgaaagagccttcctacgtaccgcaaccgctctcgtagtatcacctaattttttctccaaagcgtacaaaggtaacttaccgtgaataaccaaggcagcgacctctttgttcttcaattgttttgtatttccactacttaataatgcttctaattcttctaaaggacgtattttcttatccaagctttcaatatcgcgggaatcatcttcctcactagatgatgaaggtcctgatgagctcgattgcgcagatgataaacttttgactttcgatccagaaatgactgttttattggttaaaactggtgtagaagccttttgtacaggagcagtaaaagacttcttggtgacttcagtcttcaccaattggtctgcagtataactggtatgaattctagcagcatttaataaatacacattgatgacagcactgcatactaaggcggaaagaactaatttactgacgaacctatcacgaatggcaacactgacattacgaagcaatagaagaaccatatcctcaatgcgttggtaggacttaatgggtttgtaatataataatggggtgacactaacaatagcttgctctttaaagttttcagaggcattcgaggtaataaaatctggtagagaaacacgttccttatcgaagtacaatgaattgaaggcatcattgacccaatttgcaccaaagttataaaagttgatgaagacgaacaacagtatgacagagagtttcatgataatgacaaccacactgagatttaagaaagaagatacggatttcttttctgccttagaaatgattcttgctgtagatggaacaacaccgtcttcttctaatgtttgcttgataatagtagatctgtggataacattcatttccagtctaagcgctaagatagcagaataaaatgtaggagttaaaatcaattcaaaaattaggataaatgctgataatatgcagaagtttgtcaaagtcttcaattggtgagcatacatagagcatccgataaaggcaaaaatacaaagcaaatggtcttgaatcaaacgaccaccctcttcgctcacggattcaaaaacgatttcatcggtagtaatccttttagataaaccgactctttcaaatttctccagggcatactgggcaatcttgattttgtgcttgaaaccaacaacaactacaatgaaaggcaaaccttcaaaaagagttaatgcggaaacttctttgcctagaatacattgggtgacatacaatgctaagaaaagtgatgatgcagaattgaccactgtagaggcgctcaaccaaaaatttgacccggtcttcctcatgtcattgaagaggccgaatatggtgtagaacatcattaggtaggcagtaaccataataaggacgtcaaacgggtctgcttgggttacattttctgaaaatacatcgtagagagaatatgctaacgtctttacgtcgaaaagactttttctgtcacttcttaacctccatttcgttccatcagtagaagaaatttctttggaaacgctgagatcttcttgcagaatatattttgtattatctttctcaaaaaccgtgttagctagttctggaatggagtcagtttcattaggactattgaagttcaggtttaatagatagtaatggtgtggggctggtaactcactagcttcatgcgcggtgattgatacccaaccatctagagaggaatctctgtagtaatgggaacattcttgaaatagagtgttggagtctttatttggagcagtttcaaaaacactatttgaatctagttgccaaccattgaagtaatactgaatgacggatagataagcgaatgcggatatgattagagaaaaaagtattatatgaattggtcgtttcgccgaaaatcttgaaacataggcaattggctttgccatctgtttcagtcccttgaatagcagcggcatgcttgttttatgtatttatctactttgtatcaacaattagacaatgatacactatgttccagcccttagtcttttcctgactagaattgggtagaaagaagaaaaaaataagttaataaaaatcaaaaaaccgaagacgaatatagctctttcaagttgtcttttttaaaggaatgcctttgaaaattagatcttttaaactttcaaaaatctttgcctggatttatcgaacaacagcttttcatagccgaaaagatacaggaaaaatgaggaagaaaccgatgaattgttttataagctatcacctagcgataataataggtaaagtagagatcctatagctagtacggacctttctttcggacgttctatagagttttaaacgagcgggcgtagagactcgcactacgttttcttcgcactacgctgaggtcttccaactcttctccagaaggcttttctttcccttagtccacccgataaaaatggggccctttgaaattccgttttgtagcttagtttctcggacttaaagcatgtgctcaccatactaccatcacccgaatgtacagccaacgccactttagtggataataagtcatgatagtggacgaacaatcggggtaaaaggggttggaagagaacggctggaatccatcaatcagcagcgtttaacggttctaattttcagttacaacgatgatcaacgagagccttatttctaatgttccctaatgtatatgtgttccggctactgtttagctgaagagctgtgtctagccttcctggcggttatcgttcacagtcagcttgcgctttatttcattaacatcgaactaaatactagaggccataaccgcaattacagctgcggcgataatctaatttaacgtcaatgtctgaattcttattgctttgaagatttcttcacctttcttgacgaccatccagtagcactcagtgaaataggaacagaaagaagataacgctttttttgccgccatatatttctttctatacaacacagcttctttatttgtatcatccgcggagaaaagtaaaatgaaaagcttataaagagcaatagatactaaaaagaaatagaatgttttcggatttacatacagaaggttgaaatattatgtaaaaagaataatatatataaacatctatccgtacgagcgcgtgtactagtttttcatagaaaccaatttaacgtcgaatgtcagttcggaattggcaggaatacctggcagagcttgcttcccgtaggcatatggtgctggaatgatgattctacgttcgccaccaacagacataccggcaacaccaatgtcccagcctttgataacttcaccacggccaagtttgaatgcaaatggtttaccgctggtgttcttgtcgaaaactttaccgttctttaacttaccaatatacctcatgcctactctggcacctctcttagcctgtgggccatcaccgatagtacggtcttcgattactatgccgccttccaaaaccttactctttggtttatgcttatcttgttcctttttgcttttgggttttgttggaccctcctctaagtccttcttaaattcgaccttctttacttttttagctttcttttcttcttctttctcttcgtgctttctctttttttcctttttgcttttcttaggttctggcttaacttcttctttttgttcttcttcttcttcttcttcttcttgttcttcttctccatcattatcttcttcatcttcttcttggacttcttcaatacgaacttcttcttcctcttcgtcatccaagtcgtccatgtcgtcgccaataatttcatcctcatctggggtcaagtcgtagtcttcactgtcatagatgtcagcgtcttcatcttcatcttcaccttcgactcccattggagtatcaaatggatgcttaacatagttaccgctcaaggagatagcgtaagaaccagtgacaatgaattggacttcttcttctggagtaatggtcaagtccaaagattgttggtattgggcttccggagataaagtcaaaaggacggattcttggaactcatcgtcctcgtcatcgtcttcttcatcatcctcactttcactttcagccttcttgcctttactcttctttttcttttgggttttttcctcttcttcttcctcagaggattcttcgtctatttcgtcttcatcaaaatcaccacctaaaaaatcatcatcttcaaagtccgggtttcttttgataattcttaaagtcgatggtttgttctcttcatcgatggcttccgggttcaaagcagccatagtaatacgaacggtgatgggcatcgtgacgtcgattgctggaaccggggtataaggttcaacattcaaactgtaggtagctagtggtaacaaatcagacatattgggctggttggatacttgctttcaattatgtatgaactttcacacaattatgtattatatagaaacgtgttagtaggctcttttttcgaatttaaaaattttaccttcacttttaaattttgccgtcctttaggaatgacgacagtccgtagagggctgaaaattgaacagcgagctaatactagtggattctaatcaatggaacatgaagcatgtatcataatctctgttcttgccggttttgactatatagatgtagatgcaattcagattttagtgaaaggtagaggaagcaagccagttgaaaaaagtagaaagtatgcgatgtgtcatatacatttggtatattctccccataatatcataaagaggtgatagtagaatgtttggagcattgatgacagattatttccaaaagaagtttgattgtgcgatcgctctcttttatgttccttgatgcatttttgtacaatatattaaagtaacaaaccggcgaaagaacgtcagtaatgtgtcgttaccaaccgtaaagtgctcgatgattaatttcacaatacatttcaaccaaagtgttttcattcaaatactggcacaaaggtttgtgtttctaagtgcctatggtgcgcgataaaatgttcttgatggaacacagttcattgctcagaaaatacgccatttatctatttgtgtcgttcttccttccaagaattacaagaattttattttttattcaatgctcaatcgtctgctcaaggacttctggtaatttacgttaaataatagctatggcgcttttctcatttctataatgcagagttggtggctataaccgtattatcgatgttattgccgttcgaatatatgtgagcttaacattgccgcattagttttgcttgaagatgctctgtccatattttgttaacccgtcttagaattgatcattgcttgctttaaataatgaagatctttttacgaagccaatgactatgttgtcttcaacttttggcagtaaagccaattctgtgagaactcgcggggaaactccaaagcacacttagagaataaaaattacatggagtcgaagcatgactcagatgatttctaacgtcctgacatttactcgaaagtatttcactaccagtggggtaaaggacaatatcgacgtccgttggctatgttggtaactgagatgaagttgtaacaaattcctgcaggatgcttttacactcaccggttgcattttcctcatttcatagataacaaagtaaacagagcgcattttttggagtattttatacgtcaatgcgactttgatacctgaaatccccttaatattggtaggaacattgggctcaagcgatgcattttctcttgcattttgtttctcactatttgtcttttctactttcaattttcttatctttgttctattcccgttcctgttcttattgttttatttgctgtgagcacgccttgttattgccaacgtttaaaaccatttactttttgtttaaaaatctctcttctttttccacatctcacctaaaacaacgatcattatataacatgaggtgtattgtttttcctcaccatacgatcaaatataacatcacaaagcttacagcagagcgacacttttttgcttaacaatctgtattttgtatgatgcatccaagtcttgcgccaagaaagtctacattataggaaagatcaaaagaacttgaaataatgtattcctttttcttttcacgccctttctctgggtgattgccgcaatgaagatataaatatgcgaataaaaaaccaatgctcaatacaaatgcacttatgaaactgtagttaaattataattttacctgcatatatattattatagaagttcgttaaaataattatatttaaaatttcaacatgtgtggcttgtcaccgttcttcaaagagaaagaagcagacaagtattgcttcaataatggagtcttcttgatttcagcaatcaaagccttgtcgacaaccttttggtcttcaacacgttcagccttgatttccttgttttgttgttctgggaacaagttagcttccttcttttccttcttagtcaatttttccttagcaaagtattcgacattgaatttttcaacgttgacaccttcgacagaaaccttagtagaggtagcaatgacgtaacgagcattgactcttctcaaaggaacaccattgaccttgaatggaccagaaatcaacaaagtgttgtcttctagatgcttcaagtaaacaactctcttacctctgaaacgaccagctagtaagatcaagacggtacctggaactagagaggcacgcaacttttgtgggcgagcagcctttctggtcttctttagagcagcgacgtcttcggatggataccactttggagcctaaatggaaaaaagaaatatcaaacgactaatgttagtattcttgatttgcgaatggtgataaatttttatagggagagattatgcctaacgatttgaaactgtaacgtgggcctttgtttggaaactaaataatcatgagctagggtcgatataccttattgctttgctcaccttctcactcatagtattaacattgtgttgaaaggtatactgccttaatcatttatcctcactgtacactgtataacgtcatttatcagttttcattgtattattttgttcgacgtcctgatcttattgtttcttgtatggatatgtctgagattgatggcatcatatcaaatttcaaaacttatgccttcgtgaatgtaaattgacatctccccctcgaaattaacatgtaggaacatactttttgggcactcatttcgttggatggctattactttgttgtttcgcctaatgtaaaactgatattcaatctttaatgagtagtacatttaatctattcatgtaacccttccattcgataacctcgataccaacgaaattttgcaaaaggagcaaagcacactccagtgggaaactggacaaatccggtgagtcctcccagacgggaaacgtgtctctcgcttctgttgtccgcccagcggagaagccctctccagaacgctttagccgcaaccgcaatggtctaggcgggccgcttctcgaatctggttaaggaaaaaactgaagaaaaatataacaaatccatacattttaataatgtacggatttaatagcagtcttcacatttctttcttctccctaagcagtaacaggagagcgttgaaatatgttgtaatatatgttgtaatatattatagtaaatataacgttatataataatagcgcaaaattataacaaacacagaaaagacacctgttaacacaccaaatgtgcccttattgagcgtataaaagaatagttttcactgtttattactgcgtgtattcttgaggaacttctggcacgggaggtacctgactattcttgtctttaccgtaattaatctttacaatcagatgaccgtctcctaattttacagaaatttggccatcttgttgaatttgagggtcacccaagttgatttgagcaataccaagatctttgtccctcgatagtctttgatgggaaattgcacccagtaccaaattggcttcgggagaagccttgaacgagcactcttcatcaaatacggcaacaccatcattattggctttttggcttttcgttttgtatatgtgttttagtctaccaccttgagttaaagagatcttaatttgaacatgcttggcaacgttttccgcagcaaccacggtaataaaaccattgtaagtgccatgaggagctaaagtacgcgcaaaactgcttgcacgagaatgtcctctagagttgctactaggggtatcttttttgttgcttgagctagaagtgttgtcagttggcttgactgcaggagatgcgctttgaacgggcgcgtaacttgtgttaggtactgatggatcatagtctagtgaagctcttggtgttacactagtgctattcaaattacttggggatctcctatcaaaagattttttctctgatgatttttttgcaccgttggactcatttccattgctgctcttgcttcttttcattggattgccacctagagattttagaaggtgaccacctttctttaaaccaccagtggcaactcctgttgctgctcctataccagtaccagctatgccaacagttgcatgggctgcaccactggctattttcatcggcttatcagtgataccgcctttcacgatatcaaaacttggcttgatatattctgggttgaatgaaccttgtaatttgatacttccttgtgtgtttaaattcaaattccagttgtaagttttaccaacttctaatgaggaaacgtcaagtgaagcttggcctaagtcgtcattatcacctgcacgatcccaatcaagaacattaaatatgacttgattcttacttcttgaaaggattggtattttagcatcttcgttccatacgggatccaatgttttctttttaatgttcgatttgaaaacttttttaccattgacatagatgtgaacaaatggatctgaatagccattcctatctgcggacttcagaccgtgtccggaaataagctttatattcaaataaccagtgtcttcaacactttcactgctaggcagtttcacgctagtgggcgtgtacaaaaatcttaccttcattttagacccattgaagtttaaccacatgggctcttcgtaagcttgctttagtagcttcaatgtactataggaagtttcggatatgacatcatctgaatctttggcaatatgtttcttcgatactctaaaatgtagtttactgtaattcaaatctctaatgaaaatatttgccatctccgagtttagtttaccttgagatggtttcatgcaaatgaatacagggtacgaaatgtcatccgctaagatttctaggtaagcagaggatgggctcaaagtcccttccaatatttgcatagacaaaataccagatttttgcttgatcaactcgtttaaagataacttggccttcctgtttatttttttttcatcgctgtcaaatgggtcctcgatctcggcaacttcccattcctttggatttttttccatctcttgctcgttttcttcttgggtagcttcgaattttttcttcttttccttcaactccttttctagtttctcaacattcaccaactcctcaggggaatacaccagattgattgggataaatgttgttgaaacattgacaatgctttcggtaactttgtgtttgtggtcttttaattttagttttgaaatttcttctttgtcattattcccaacatattttcctgatttaggatcttttttgaaaacatttgatgtaggaatttgtacagagccaatgaaacggtctttgccgatcttttgataatcatgaaattcgagagtcaaaatttgatttggagagaagataggaacgtaggtgctgttgtcaaaaatgggatgatccgtatcagaatgatatatggacttgtaaagaacacgtctattcaacgatacggtgtaatatggatcaacatcccctacaccggataagtcacccttgataatggcatccttaacgtctagcttaatacaaccaataggttcgcttacagagtttgcagcggcaaaagctccggtcatttcaattgatttccaagtaacatccaaataaatgtcaccttgtggtgagcctttaacaaactcttgagcagcgtctaaagtagtcattatatcatctaaagaagatgaatactcacagatcagcgccttaccattcattctgtcatcgaatatttttaggacaaacttagagttagattttgatggaaccaaaacttcgatggtctcattccaagatggctcattgatacgtctcaaagttctatagctctttactttttgtccatcaatgaataattcagcacatgggctcaagctaccggtcatagaactggttgtatccagatatttgaccttttgtaaagtgatcttggcaatcccgacatcagtttgagaactttcttcattctcgtcttcttctttttcagtagtgtcctcgttttcatcttctttcttgcccttggccttagcttcggcacgctcaactgctttttcctctgatttatcttctttcacagggaaccagtgtaaggaataatgtaaaataccttttgattttgtaccggatcttaattcagcagtttgattatccaaaacagggttttgtagtaaatctgccaagtcaagttgaagatcaccaattacggtatcttttcttacatcattgaagtcaaagcactttaagtttaacttttgctctaaggtgtttaataatagatatttggtttcgttccaacgtggatttttaacatttgatttgatagatgtacgcacttcttcatctgtaccaggcacagcatcttcggtagtcataacaatataaggatcgacagtattggtaatgaaatctgagcctttcaaagagtcggcagaagcaatggttacggcaaggacaccaatagcttcttttgattgagcagccataatgtcttcaacattaatatccaaatggttcggagggaatagcataggccctatattggagttgataatgtttttaacaaaactcttcaaaccaggcaagaatgacataacatcaagacctaaagtatcaccaccaattggtttcagtgcgaaatcaatcaaaggtggttctaaaagttgtaaagaaacaattttgatatttgggaaagctttaccaaattcaactttaatacgcattttaccagcaacgttaatgtcttcaaccaaaataggcattgttttagagacaaaactttttcctaacgtgacacccagagatatttttggattgatcttctccctagcttcagtagctgtcatatccgagacatcgcttggggtgaatgcaaatgaccaatccatttcaacagtgtttttaccagtcttggtgtacgatttaataccttttatggtgggagctttagagcccagagtgaattcatcgatagctaacgcatcgataccgtagcctggagcaacacctgccagttgagggttaacgttatctttgacttgttgagataaaactggcatataaatcacccaaaattttgataaaaatgaattcaaccacgtagtggattcaacgcgatccgacaaggtttcttcgactgtaactcttttcaagtcatctctgatatttctgttgaatcttgtatattctgcgttgtaaacggtcgcagttcccaagaagataaatatcatagaccaccatgaaaacccaatgtaagcaaataaccatgagaagaaacaagttccaagaacggtggctatattacagtaccaatcgttataaaaatcttccagaatgtaagcttttataaccctggacatctttgtatttggcgaaccctttcctgaagcatggaactcaccaacattttgccatggaaataacttgtcgtcggaatctgggtgaaatttttccttaatatccttttcatcaagtttgcctaagtcgtctaagacgccaggcttagtaatcgaagtgtcgaatttatttggcttcctagatggtgctgatctgaattccttcggacgtaaatcttccaatggcacggctcctatgcttccctgtgggttgggaccgggcaattgattggttttttgagcgctggaggcaacaaatatgtcttttgatgactgtttcttaccttccgggttggagtcagcagttttctgacctttagacacatcagaaactgaatttgaggtctttgtgtcatttgcgtcatggttaatcagttggtggtattgatggtgacccgatggagcgtgatcagaacccctttcttgttgatttatgaccttttgaggtaaattgcctcctactttcttcttctcctcctcatgaaatagggtactatcaggtgggggatggacttgagctttgatgccagtcatttttcttgactttcaatgcgtagctctacttagtttctttctagcaatattgcgtatgtcaataaacaaagctagctaatgatgctctttatattgttaagaagaaaactgattaaattaagtaacgctaaaaagcaaagttgtctatcaaagtgaaatgtatcgcaattggaaaaggtaagtgcaattggaaaaggtaagtgcaattggaaaaggtaagtgcaattggaaaaggtaagtgcaattggaaaaggtaagtgcaattctaaaggatgtaaggtacagttatccctttttccctttctgactgcagcagtgtgttgtaaaggtatacatacattctcgtattgttgtttctcccccttctcgcgctggcgaagaagtgaaaaaaaaaaataaaaaaatggaaatttcggacgatcgtcattttgaaaatacatagtgaggcaatattatactaggagtatatatatttagaggccagttctgctctcttgtcaattgcccgggcgagctgctcggtcgtaaacaagctagtgtcattaattttttttaggaagaggtggtggtagtttcgattcaggtcgcaaagacggaatgaacagtacaccaactgcaggcaaacggagtcactcagcttgatgctattcaacccacgagtgaggtcttttaatacgtatgttatgcacttatcaacgaattgcaacatgactgcatttgtaggtattttgttttccctttttgaagtccgaatctttttgcttggctcttctggggtcacctcaaccttattaatttcttcttcctctttttctgccttgttatctttggtatttacttcttcctctttttctttttcagccttgtcttctgttttgtttactgtttcattttctatctcattttctgttttcctttctgctccatcatcttcgccttccactttgccttgtacttcctcttgtacatcttctatcgatttattttctgtcacatcttcttcattgttcgctacgctatcttgtttttgatattcttccttctttgtttctttctccttttcttcaatttctttctcttcgttagtcccatttatccttagcacagtactttctagttcctctgggaaaggaatctctaagtcatttgtatcatacaagaagcttttcagaaagacattcaaggacatgtagacatgttccctgaggacttcaattttcctcttaaccatcatttcaattaaagattcattagaagactcaacgtccaaaggatatgatgctatttcatcggtaatgaatttgtatctcatggctaaaaacacacttaataatgatttattagtctttccatcgaatggtggaattgaattcaagtactgtagtattttctttagtgagtttactgatacattagtagacagtaattttaccagcccggataacatggtagtactaatttcgtttaaaactttttcgcaaacttcatccacaatggttgaaccagggaatcttgacctcagggaagtagtgtgtgtgtatagcatgacggcctcttggtaatgacctgttctgatacatgtgcgggccaaaaatggtagttccatcaaatccgtaatgctatccaaattttctagtacagtgactaatgtgtcagatctaatgtcgtccttgtcatcttctttagttgaaattctgtttcttaacctacttaatgccttgtgaaactcatccttcttcttctttcttgccagattgttactctcagtcgtcatgatgcgacctgtgtcgttgtcttctttatcgtcttccaaaaagtcatcaatagaaacgctttcattgtttatatcgtcatttgtaacgtttcgatcggctgccttattaatattagtatccaattcccataattgctccaaagacttggctatatcatccaattgagccctatcatcgttttcaagaatatttccgataatctgagacttattatctagtagtgatttccttatctttctatcaagggcagataattcagcatcaatttctgctatgtcttcggttatgctaccaggaacagccctagatgaaaaataactttcatagtctttcgtgttagattgtaggatatcctgtaggaaatcaagacttaaccgtttttgttcctctgttaaatcatcagaaatgaggctgtttagtatcagctccattttactcaatgattatgtttattgttaaaatatgttccctcaaatgtcctaacacttctatgattattttttctctgcttctcttttcagtatgttactacgctatatttttagacattgaagccatgatcgcgagatcgatctaatgtacgtataaaaagaaaatggacttcaagagtacaactaactaaaggaaaatccaactcttcctataaatttagaattagcatactcaaaaaagaagaaacaaagcactcacgatgggggtcgaacccataatcttctgattagaagtcagacgcgttgccattacgccacgcgagctaaatttcttgaattgttggttaaacaggaattactaatacaaatgttattagaaaccaaaaatgcacttttccggggttaatatatatgattgagtgatggatgaagaatgagataattgtttaacttctatagttgtcaaacgctgtgataccagatacacagaatgtactagaggttctcctcgagaatatgaaaatccacaatagagaaccgatatttctgtgtaggaatattattatttcttctttcattttgtatgttctcgttcattttcctagcacattatcaaccctttcatttcaatttccattaaaattggtgactgtttctcaatatttatttgaccgtcttatacccaatatggtaatataccagtaatataaatactagtcgttagatgatagttgcttcttattccgaaaatgagtgtggaagtgttgcatatgatagagcggctacagtgatggtaaacataagatactttagcgggaaattagcaactggaagttgaattatccagacattagtgtggcggtcacgctgaacgcaggagatcggatagattgataagctgatcaagaacattgatcggtttgttgtttaaagaatggtttttgaaaacgtttgaccagttgcttctcccagacgcttatcgatatgatgataaagataatatcttcaattgaataccccgtggatcagcacgaataacagaaaaaaagggtgaaattcaccgtaagcatgatacgcactacgttcttcttacctttgccaacgtgttgtctttgacgtacgtaattatgggagatcgttgatgattagccccagtttactttcttcttaatgactgacccgctactatcaaaattaaggtgtcaaatatcatgatgaatgaggtctctaggcgactcaattatacatcttttagagatttttttactacttgcagataatttttcaagggattagattcaaatctggcttgtcaattacgcccttttcaagctcatcaaattgcgtatgtcattcatgcttccattaggaaccatagaagcatggctgaaatggcaatatacggcttcccaatttcaactctaaagttatggcggtcgaatttaatctatattttacagttttatacgtactttaaaagcaatcagtaaacacctctggtgctattcaagggttttttgcctttatttgttactgtcaattgtctggcgctgtgataaaaaacaaggcataaagctccccccgtcatgaacattaagactcgctagacgagagagtgaaatataatgcatttcctgattcaaatgcgctacaaacatggtgtaaatctggcccggagtgagtgcttgccatttggcttctaagggagaaagatcaaaccactcccaattgcgtcattttgaaagagtggccacctcgcgagcgtctgtcgaactaactgatgaataaatatataaggagaaaatcacttcaacttcgctacaagtagtcactatttgtagcaactgtaaacgaacacatcaaagaataagattacattctatatctaagactaaattttaaatgtccgctaaatcgtttgaagtcacagatccagtcaattcaagtctcaaagggtttgcccttgctaacccctccattacgctggtccctgaagaaaaaattctcttcagaaagaccgattccgacaagatcgcattaatttctggtggtggtagtggacatgaacctacacacgccggtttcattggtaagggtatgttgagtggcgccgtggttggcgaaatttttgcatccccttcgacaaaacagattttaaatgcaatccgtttagtcaatgaaaatgcgtctggcgttttattgattgtgaagaactacacaggtgatgttttgcattttggtctgtccgctgagagagcaagagccttgggtattaactgccgcgtcgctgtcataggtgatgatgttgcagttggcagagaaaagggtggtatggttggtagaagagcattggcaggtaccgttttggttcataagattgtaggtgccttcgcagaagaatattctagtaagtatggcttagacggtacagctaaagtggctaaaattatcaacgacaatttggtgaccattggatcttctttagaccattgtaaagttcctggcaggaaattcgaaagtgaattaaacgaaaaacaaatggaattgggtatgggtattcataacgaacctggtgtgaaagttttagaccctattccttctaccgaagacttgatctccaagtatatgctaccaaaactattggatccaaacgataaggatagagcttttgtaaagtttgatgaagatgatgaagttgtcttgttagttaacaatctcggcggtgtttctaattttgttattagttctatcacttccaaaactacggatttcttaaaggaaaattacagcataaccccggttcaaacaattgctggcacattgatgacctccttcaatggtaatgggttcagtatcacattactaaacgccactaaggctacaaaggctttgcaatctgattttgaggagatcaaatcagtactagacttgttgaacgcatttacgaacgcaccgggctggccaattgcagattttgaaaagacttctgccccatctgttaacgatgacttgttacataatgaagtaacagcaaaggccgtcggtacctatgactttgacaagtttgctgagtggatgaagagtggtgctgaacaagttatcaagagcgaaccgcacattacggaactagacaatcaagttggtgatggtgattgtggttacactttagtggcaggagttaaaggcatcaccgaaaaccttgacaagctgtcgaaggactcattatctcaggcggttgcccaaatttcagatttcattgaaggctcaatgggaggtacttctggtggtttatattctattcttttgtcgggtttttcacacggattaattcaggtttgtaaatcaaaggatgaacccgtcactaaggaaattgtggctaagtcactcggaattgcattggatactttatacaaatatacaaaggcaaggaagggatcatccaccatgattgatgctttagaaccattcgttaaagaatttactgcatctaaggatttcaataaggcggtaaaagctgcagaggaaggtgctaaatccactgctacattcgaggccaaatttggcagagcttcgtatgtcggcgattcatctcaagtggaagatcctggtgcagtaggcctatgtgagtttttgaagggggttcaaagcgccttgtaagtaattggctcacgaatacataccaagatacttatgatatatatatatagaaaaagcttacttttcttggagttattgttattatcatcgcgaagaacgattgtataacccggctcaacgcgaaacggatcgttaaactggtgaaatgttaacgcgaatgtcagagatatacatagtatgagagtagctagatgttgaatcggtggtaagaacaagaaggaaataccgtcaacaagtgaaggaacaatctagtattgttgaacaagaattatgagtaccgactttgatagaatttacttgaaccaatctaaatttagcggtagattccgtattgctgattctgggttagggtggaaaattagtaccagtggtggctctgcagcaaatcaggcaagaaaaccatttttattaccagccacagaattatctaccgtccaatggagtaggggctgcaggggttacgacttgaagataaataccaaaaatcaaggtgttatccaactagatggattttctcaggatgactataacttaatcaagaatgatttccatcgccgttttaatattcaggtagagcaaagagaacattccttacgtggttggaactggggtaagacagaccttgccaggaatgaaatggtttttgctctaaatggtaaaccaacttttgaaattccttatgctagaataaataatacaaatttgacctctaaaaatgaagtaggaatagaatttaatattcaagatgaagagtaccaaccagccggtgacgaattggtagagatgaggttctatattcctggtgtcattcaaacaaacgtcgatgaaaacatgaccaaaaaggaagagtcaagcaacgaggtcgtaccaaagaaagaagatggtgctgaaggagaagatgtacaaatggcagtagaggaaaagagtatggcagaagcattctatgaagaactaaaggaaaaggcagacatcggggaagtcgctggtgatgcaatagtttccttccaagacgtcttttttaccacgccaagaggtcgttatgatatcgatatttacaagaactccattagactcaggggtaagacctatgaatacaaattgcaacatcgtcaaatacaaagaattgtttcgttaccaaaggcagatgatatccatcacttattggttttggcaattgaacctcctttacgtcaaggacagaccacctacccctttcttgtcttacaatttcagaaagatgaggaaacagaagtgcaattgaatctagaagatgaagattatgaggaaaattataaggataaattgaaaaaacaatatgatgctaaaactcatatagttttaagtcatgtattaaaaggtctgactgaccgtagagtcattgttcctggagaatataaatccaaatatgatcagtgtgcagtttcatgttctttcaaagcaaacgaaggttatttgtatccattagataacgcgttcttctttttaactaagccaactttgtacataccattcagtgatgttagcatggtaaacatttcaagagcaggacaaacttctacgtcatcgaggacgtttgatttggaagtggtactgcgttcaaatagaggttctaccacttttgccaacatcagtaaggaagagcagcaattattggaacaattcctgaagtctaaaaacctaagggtgaagaatgaagatagagaggtacaagaaaggttacaaaccgctttaggttcagacagtgacgaagaggatattaatatgggttccgctggtgaagatgatgaatcagtagatgaggattttcaggtcagctctgataatgacgcagacgaagttgcagaagagtttgattcagatgcggctttaagtgatgctgaggggggcagcgacgaagaaaggccttcgaagaagcctaaggtagaatagtaataattttagactgtataagttaaatttattgatattgtgtaaaaactaactaatatattttgccaattgatattatcatgacatggtgagtgtaagacaccacctcttaattactggtgttattctatacatttatttgaaattggttttgttttgcaaaatatttatgttttgttaatctcctctaccctttcaatgcttgaaaaatactttcaacttttcgattgggtgatgaaaaaaagacaaatagtgtaaagggttcaaaaataaataacaagcaagagaaagggactttgcttttctcatttagtcatcagtaagttatgtcatggtgtagaataacgaattacagaaaactaatacaactgatgaaagaccagggagtaaaatggctttgactcagtttgaaaatgatttggaaatattaagagatatgtacccagaactggaaatgaaatcggtaaaagtagaggaggaaggtgaattccctcaaagaattaacggaaagttactgttcaagatatcactattgaccgatgtaaatattgagttcggtgaccaacatatgttactttcaaacttatctaatgaatgcgtggagttcacaatatatagctgtcattatccggacattcgacggtgtgttgttatggatatcaaatccttatggatatcaacagatgaaaagaagatgttaattgagaaagcgctgagacttgttgaagaaactgtagatatgagtattgagttcgcggattcgtttacctccatccttatcctcatctttgggtttcttatagatgatacagctatattactattccctaatggaataagaaagtgcctgacacaggatcagtatgacttgtttaagcagataggtgaggaagcgaccctccaaaaagtgagcagatctaactaccattgttgtatttgtatggaaatggaaaagggtgttagaatgatcaaattgccatgtggaaatgcgaatgtggaacactatctttgcagaggatgcgccaaatcttatttcactgcaatgattcaggaaaaccgaatatccagtgtaagatgtccacaatgcgaatacaaagaattaaaactagaagatttcaagagctataaaaaaatgctgaaggcattgtttacacctttgattccagtgtccttcttaaaagaggttatcgatacagagctatgtgaaagatacgaaaaaatgttctacaaccaggcggctacaagactctcaaaatattgtccgtatgcttgtgtgacttgtcgaagatgtgatagttggtgcacaaaggaagatatcgatgatgcgatgattcagtgtcaaaaatgtcattttgtattttgttttgactgcttgcatgcctggcatggttacaacaataaatgtggcaagaaagtttcgttatcgaccgatattattgaggaatatctagatgataccgttacttcatatgagagaaagcggaaactggaggcaaaatatgggagaagagtattagaacttgaagtcaatgattaccttgctgaaaaaatgttagatttagcgattaaaaaagagggttcgaatttgcagcgatgtccaaggtgtaaggtagttgtagaaagaagtgaaggttgcaataaaatgaaatgcgaagtatgcgggacgctgttctgttttatatgcggagtattactttatcctgaggacccttatgaacattttagagaagcatattcaggctgttatggacgattgtttgaaggtatgcctggcacagaaacttgagtgcgatcgctctgccttcagtctcacactttttcttataatctattgtcatgaaatttatacagatgaaaatgaaacgttatcttgggtatactgcattctcttttcttttacatatctacctatctaaaatacccttagttttatcatctggctgataacgtaaggaccacttaggtcccatgatggtgataagagccatatccagtagtgtgaaaatccacgaagcacagtaaaccaaaaatgagcagattgccactaatctgaccaaaaactgtatgaagcttaaacgaacatcagaaactactatagataatggttcgaaattgtatttgaagaagatgcccggcattttatcacctttagcagcgacatctttgtacaaatagcggtaatcgttaacagaatattgattagtatccacttctgcccccaatttcttaaaaagagtgggcacaacagatgtgtaatagacgtaagtagttaaaggttcatcctgattaaactgtgcagtgttatccaatgggttatcaatatatggatagaaatcaccaaaagagaactcattaataacatgattaaattttaattcttccagtggtgctttgcgtgaagccacgtaacctaaactcttcgctataatctgcaattcgccactaactctatttaccggaatggacccaaatatatggcacccattgaattccggaagatgtgccttgttaggatcactttcatcaaaaaatgacctagtgtctagtttttctctaaattctgctgggatagcttcccctaagatttcatccaattccggcgtaataatttcattgatatcattgacttttgtgtcataaggaataaagaatggcatctcttccaattgcaattcctctaatacaagtttccgatccattgtttggtctctgacgttgatttgcaaccaatcacatttcgtgttgacgtatatatccatattaatttgaacggtatctctaacttgactgtccactacgtactgctggtcaatataaccaccgaagtattcaccaaactcggtccatgctataaacaacagaaacagatatgtcaacaaagatgttaagccacccttggtggatttcttcttgtactgttcttcagtttttgctgtaaagttaaatttccattgttagtgaaaaagcaaaagcaaaaataaaatatgctgaagcgggctacttcagaaaaatccatataacatacgaaacgcatcaaatgtcttcaatcctgccattatatactcctgaagtctctgcctgtacgttacagcaaaagcattttggaggaacgcttttctcagtaagaatagaacattgataatatcttttcaaagccttgaccgagcggaaaaaaaggacgttatgcaaaaatacttaatatactgaaaggctgtgtatatgtttacatatttactgtcatttgaaaaaaaagttctgtggtgaattacttctccatcaagtctggagaaggggagttagatgtgtcttctgtatacttatcagactttttgggcttagctttgtaatgatttgctgcgagaaatgcgagtaccaataggacccactggatggcatacctggcgagccccataatgaacccacttcccacgtttacctttaacagttcccagcctgtagtgtgtacagcagcattgtcagatcctacgtctgttacctcttcgggttctaatgttttcagtgcaatcaaatatacgatgttacataatattgtcaatgtagcaataacaactaatattgaacttgatgacttcaaaagcataggaaataagcggtgtcgtttcccaacactaagtgctcccccaaaggctgacactacgcagatactgaggaatccgactattatttccaacactgcaaagtaaaaaaccatgccgttgaacatcatcagtataaatgccaggttgacgcctttcagatagttttttgttggtgacgcgccttttacatttggatcaggactgccaatcaaggcctttgatagggcatttcctgtgtacttgtcgtgtttcaaaaaatcacgaatagatgtcaatgccaaacggtaggtcaatacgagagagtctccgaattttttggtttcattcgatcgtgtagtggaaatgttacctaattgaatcccgacgtctctgacaagtacttcaagtacgtccatgccataattctcattagaggtacaataaactttgcttttattactccgtttacaaaatccaaaataattgagctcaaaaaccttatcaggctgaaatgtgtccaccaaattttcatcctcatacacacttggatcagtaaattcattcgaccaacccatgtcaattgtcaggtacgaaatcaatcgcagaaattctcttacacttgcaataaactcatttgcagtactggatcctccaatcacagttatagtaaactgtggagcgcataacctaagtcccttagagttcgtacatgttgtggccggcaggtagaggacaaattgtgataaacttaaaatcaatagaacaccccacacaatcagacgtttagggaataacatgctcgcccttttatgttatgacagaaagaatatatatattcatatataacatgcttctatttattagtttatcttttaattgatggatgtgttcatagaatttaagtaagtgcatggtatggagtgtataatggtttataatttcccctaagatgacacaaaaaaatgttctcccaaaaatttaccaagaaaaaaaattaagaatactacacaattgatgcttgggttattttaaatatccggtacattctattacaaatatgtttgtacaatgtaagcccttcataatggtcagtattaagataaggactgctatggggcattttttgtcttactgggtaccacaggataataacttagcgccaaattagaaaagatataaacctcaaatatttgaaattctttggtgacctgtctcatcgttatatcaacaaaatattgcaccaacgaacaccactacatatgtaactactctcttcctcgacttattttttattaacgttgacacggccagatcgaaaatcatagaaaaacaacaacattgagaagagatgaagttgcgcaaagggaaagaaaactgcataggcggcaaattcagcctaaaagtttccagaagcaggaactcattccctattgatcaatactcattacgaaagccacaatagagtagagaagatggcaaaaacgttgaaggatttacagggttgggagataataacaactgatgagcagggaaatataatcgatggaggtcagaagagattacgccgaagaggtgcaaaaactgaacattacttaaagagaagttctgatggaattaaactaggtcgtggtgatagtgtagtcatgcacaacgaagctgctgggacttactccgtttatatgatccaggagttgagacttaatacattaaataatgttgtcgaactctgggctctcacctatttacgatggtttgaagtcaatcctttagctcattataggcagtttaatcctgacgctaacattttgaatcgtcctttaaattattacaataaactgttttctgaaactgcaaataaaaatgaactgtatctcactgcagaattagccgaattgcagctatttaactttatcagggttgccaacgtaatggatggaagcaaatgggaagtattgaaaggaaatgtcgatccagaaagagactttacagttcgttatatttgtgagccgactggggagaaatttgtggacattaatattgaggatgtcaaagcttacataaagaaagtggagccaagggaagcccaagaatatttgaaagatttaacacttccatcaaagaagaaagagatcaaaagaggtcctcaaaagaaagataaggctactcaaacggcacaaatttcagacgcagaaacaagagctacagatataacggataatgaggacggtaatgaagatgaatcatctaattatgaaagtccgtcagatatcgacgttagcgaggatatggacagcggtgaaatatccgcagatgagcttgaggaagacgaagaagaagacgaagacgaagaagaagacgaagacgaagaagagaaagaagctaggcatacaaattcaccaaggaaaagacgccgtaagataaaactaggtaaagatgatattgacgcttctgtacaacctccccccaaaaaaagaggtcgtaaacctaaagatcctagtaaaccgcgtcagatgctattgatatcttcatgccgtgcaaataatactcctgtgattaggaaatttacaaaaaagaatgttgctagggcgaaaaagaaatataccccgttttcgaaaagatttaaatctatagctgcaattccagatttaacttcattacctgaattttacggaaattcttcggaattgatggcatcaaggtttgaaaacaaattaaaaacaacccaaaagcatcagattgtagaaacaattttttctaaagtcaaaaaacagttgaactcttcgtatgtcaaagaagaaatattgaagtctgcaaatttccaagattatttaccggctagggagaatgaattcgcctcaatttatttaagtgcatatagtgccattgagtccgactccgctactactatatacgtggctggtacgcctggtgtagggaaaactttaaccgtaagggaagtcgtaaaggaactactatcgtcttctgcacaacgagaaataccagactttctttatgtggaaataaatggattgaaaatggtaaaacccacagactgttacgaaactttatggaacaaagtgtcaggagaaaggttaacatgggcagcttcaatggagtcactagagttttactttaaaagagttccaaaaaataagaagaagaccattgtagtcttgttggacgaactcgatgccatggtaacgaaatctcaagatattatgtacaatttttttaattggactacttacgaaaatgccaaacttattgtcattgcagtagccaatacaatggacttaccagaacgtcagctaggcaataagattacttcaagaattgggtttaccagaattatgttcactgggtatacgcacgaagagctaaaaaatatcattgatttaagactgaaggggttgaacgactcatttttctatgttgatacaaaaactggcaatgctattttgattgatgcggctggaaacgacactacagttaagcaaacgttgcctgaagacgtgaggaaagttcgcttaagaatgagtgctgatgccattgaaatagcttcgagaaaagtagcaagtgttagtggtgatgcaagaagagcattgaaggtttgtaaaagagcagctgaaattgctgaaaaacactatatggctaagcatggttatggatatgatggaaagacggttattgaagatgaaaatgaggagcaaatatacgatgatgaagacaaggatcttattgaaagtaacaaagccaaagacgataatgatgacgatgatgataatgatggggtacaaacagttcacatcacgcacgttatgaaagccttaaacgaaactttaaattctcatgtaattacgtttatggcgcgactttcatttacagcaaaactgtttatttatgcattattaaacttaatgaaaaagaacggatctcaagagcaagaactgggcgatattgtcgatgaaatcaagttacttattgaagtaaatggcagtaataagtttgtcatggagatagccaaaacattgttccaacagggaagcgataatatttctgagcaattgagaattatatcatgggatttcgttctcaatcagttacttgacgcgggaatattgtttaaacaaactatgaagaacgatagaatatgttgtgtcaagctaaatatatcagtagaagaagccaaaagagccatgaatgaggatgagacattgagaaatttatagattcggtttttattattcatgacctagcatacacatacatatacctacatagtagcgcatttatccaaaacatacgatattgtggatgtacataccttctatatctccctaaagctattgtgtagcttgatttaaaatatgctaacgccaactctcacatggtagcaggcgggtatagttgttttcatgtattaacgcctggcgatggtgccttagatgagggcgacgaagagggcttcctgatattatggctctttctatcctgacttttgttatgatgtcgatgttgctggccacctaggtgcttgtatatcaaaagaggatcgccgatttcattgatttctgggatggttaatgtcaaattaaagatctttgccagtgcaattttgaaaattttttgaatgtttatagatttggcggtagagcagaatataagaggagcattcatgacctgtgcatacttcatactcgttctcgagatttgttcctgatattccgggtctaagtctattagtaaatcgtactttgtgcccaccaaaataggaattgccgaatcatttagcccgtacgcctgcctataccactcctttattgaactcaacgtctctggacgtgtcaggtcaaacagaaatatgatcactgaagaccctaccgtcgcaattgggagcatgttgatgaattctctttgtccgcctaaatccattatagaaaatataatatccgtggagcgtatgcttacttttcttttcaaaaagttcactcccagcgtctgtgtgtattccttatcatatatgttctgtacgtacttcaccatcagcgatgttttccctacttgtgcatcccctactaatccaacctgaacttcaacctgatttcgtaccgcaggtatagaattgtttgctcccgtgcttggtgtagccatcttagcttaactcaatttaatttctacagcaaaatccaaacgtaatatttatatttttctcgaaaaactgaggacaagagccaatcaatcatctataatccaatttatattattttttcccttctgggttcttttcttccttttcttgtttaccttttttgctttttcataaaataatttctctagatttgaagacagcatttttgtacatccatacaccatacaccatagcaccagtacactatatttttatgaattttactaagaattattcctgcaggagctccactgaaaaaaaaagagcagcatggatgcccggtagaagtgctactgagtaaatgggaaggacgcggtagatccagtgtggaatcaaggtggtgccggtgtgaagccgcctcggccggctggactctccaggccggagtgatgattgccacgctgaacgtaacacagtttcacaataccagtgtcctcattagtgagttccaatgtatagttagtagtggtattttgatatatgtgagtggtagcagatttgaacttagttagttgtattcgcctttgaggaaaccaagcaaaaaaccgatctagactaatcatggctgttggtaagaataagagactatccagaggtaagaagggtttgaagaagaaggtcgttgacccatttaccagaaaggaatggttcgatattaaagccccatccacttttgaaaacagaaatgttggtaagactttagttaacaagtccactggtttgaagaatgcttccgatgctttgaagggtagagttgtcgaagtttgtttggctgacttgcaaggttctgaagaccattctttcagaaaggtcaagttgagagtcgatgaagttcaaggtaagaacttgttgaccaacttccacggtatggacttcactaccgacaaattgagatcaatggtcagaaaatggcaaactttgatcgaagctaatgttaccgttaagacttccgatgattacgttttgagaatctttgctattgccttcaccagaaagcaagctaaccaagttaagagacactcttacgctcaatcttcccacatcagagctatcagaaaggttatttctgaaatcttgaccagagaagttcaaaactctactttggctcaattgacctccaaattgattccagaagttatcaacaaggaaatcgaaaatgctaccaaggacatcttcccactacaaaacatccacgttagaaaggttaagttattgaaacaaccaaagttcgacgttggtgctttgatggctttgcatggtgaaggttccggtgaagaaaagggtaagaaggtttctggtttcaaggatgaagtcttggaaactgtgtaaacaaaataaatataaattataagatttgacatgtacacaatttattaatatgttttctctttattattaatataattaattattactaaaaaaaagaaggcgacgcaccatacagaacttgctcttttgtccaatactgtcttttttggttgttattttttacgttaccgatttcggtttctattgaactgtaataacttgcctatgtgtctatatgccttttctatttagtaagagctatgcattatacgtggtcattttacttcttcaacagaggaagacgcactaaaatcgcttgtagtgcctccaagtttcctgcttgagtgatcgctgtctgcctcctctgcgtcattaaccgcatctggctcttctatcactccagtttctttgtctgtttcctcattattaccctggcgactattatcctcttgttgactgctttccccatcaacttcattatcctcttttatatcctcaacgtctacttccatatcatcttcctcttcattttcttcatcctcctgatcgtcatattcatgatcgctttcctctttttcgtccacattttctatagtattcacttccaccattgatctctgccttttaaacctcttttttctttcctcatcttcatccgattcataatcttcatcaatgttatctccttctgcctcatcgagcaggccatctctcttcagaagttcttctttgaatattgatgtgatcttgccaaatatttctgcatctcttagccacttctctttgtaagacgatacctcctgccttacgttttctatatccgatttcattgaggcgttgatactttctaactcttttgggcccttagagaaatcgtcataaatacgatatctctcctctgaactatcctttttcaggcccggatcaactagtttgagataattcttttcaattaaaaacttgaccagatcagtgccaagttctttctcccattccgcacgtgtcaccacaaggctggtacggccttctgacaagccttccacctctctgttaattacttggacagaatcgtaaagaccttgtagttttccaatacgtaaaagcaacttgctatggatgctctttatatcaggcaatttatctttgagattttccagcttggccaatgtctcctgttggcatgtttcccaattttcgtctgctactttctttgtgtcaattgatgactgcagatccaaaaatcgaagatgagcactttcttttagttgggagatattttgctcagtaagtttttcaatcttgctatcatcattggataatgtgccatttataatgcttcctgtcagcttggttacttttcctaagatgtctaaatatttattgaatggagtatctacttcactgtagtacactttggttctaacttggtctatttgtttttgtgacagaggcattgtgagttagtctcctttggtttagttctttgattctttttttacagccagttgttgtattttactttaatttagataatgtttcacttttttctatcgaaggaggttcaccaaaataatagaatgaacaaagcgcaagaaagaaagataaaaaggtgtcaaagaaccaatatcaaaataaatacagataaaaccgcggaactatgtatctcggccttgattattatagcagtttgtattctatataactatatgtattaatatgtacttattctaagatgtggtcttcggtatcctgaccacgaggttcgtcggaaaccaatgaatgaacttgattactattagactcttttttcaactgaaatctcttcctactgtgtctttgcaacatcgctgcgataccactattagattgtgtggtcgctgatatgggtgctggagaatttgactttgacttggatttagccttatatttagggcctggtgcgtagtctaacttcctttttttcacttgctcatctgcctcaagttgcttataggcactttcggctgaagataaagtaagataaaaatcaattaccttttgatgtgctttgatcctagttctgtcaaaatttaacacctgtagtccttctcttgaaacagctctagaaagggcaacgtacgcctgacccttttcgaatactctacgtaaatccactttaacttttggaagtgtctgaccctgagatttgtgaatggatagtgaccaggcaagcattagcggtaattgaacccttgataccagtggcttttcattttcgtcttctatcgcccaatcctccggctcgacaagcaccatcctcgtactcatatcagaagctttgaatctcacgagaggtagccttcgttttcctgcggagttttgatgtatggtctgcatcagttgttccttgcgttttatattttccagcacaacttcgtcatctgtcttgactctcttcatgaagtcaaaaactgaggaatctaggggagagaccggctcacctatatcactcttagcaaatccctccttcactgaagatttgcgactagctaccgcactttcttccccatcactttgctccctctccattgcagcttttagttttgaagggttttctgcccaagtctcgagtttttctggaggcatagatggatcgtttgttagcgcctcataacaaaaatatgtttctggatccatgaattcgatgactttaccaagggatccattaactaatgttgcgtctagattttttaccatcataacctgagcgccaactttcaaatgtaattcctttggagctaaaaaattttgtaacagtctttcctttaactcttcgtcttccaaagcaccgccatcgattgcattaaaaatatgcacctggcctggcaatttacttagtcttgaattattggccctttctacttccattctggtactataaagttccgcgggaataatttcatcgtctggcaatggtctagaaagcttcttgaactctctttctgtttcatcatcaatattgcctagtctcatccgattcaacatgtcaatgaacttaacatcacctcgctgtctaaaaaccttttgtagcataatcgtcatttttacaccttctttccaagccttggattcgaaagcaaacttagttggtctattaggatcttttgatactggcggtaactggaaaaaatccccacagaagatgagttgaattccaccgaagggttgatgatttttccgtatttttctagctatgaaatcgagtttatctagcagttctgcgtctaacattgatatttcatcgacaaccaaagcaccaatattctcccagcgccttaggtgctttcgagacctacgaacttttttatagagtttatccgcatcaccttttcctaatcctataccagcgaacgagtgtatggttataccaccgatattacaagcagctaaacccgtggaagcagtgactgcaacattctccctaccatatatgccttttaaaacttttatcatttcacgtaaaagaatggatttaccggtaccggcactccctgtataaaaaatgttgtggccattttctgccaacttgatgatactttcttgttctttgcttaagcaaatcggtatcttgactttcacaccattatggggattcaagttactgtcatcttggtcattctgcagttcagtaaagctaggtctttgcgtcaaaacagcaatcttttctccaaattgcattttcttcttttcgttttcatttatcatttccaaacttctctcttgagatattgaactattttgaagttcatcaaaagaactttcctttttcaacgctggtcttaatggatttttgaaccctgtcgatctcgattttttttgactgctctggtcaaatgagttttcagaaattaactgcggtggttgtattatactgggtttgaacatatcgttccaggataaaggactgtctttattaataaaattcatgacatttttatccctcataggctttttgtccaccgggtcttctttatgtatgtcagtgataattttcttttcttgcttctcagtttctaactgtatgcaatcaggttcttcccaatcatccgaatcagagagcaaatctaggtcttcttttgaaagtatggaaggatgcttcaattgtgcttgaataaagttattagacctgaaaccacgactactcatagaaaacgatagtttggcgtgcgatacgtttttgagtaaaagaaaactgttgaaactacagataaatggccttcttggtataatatgattcaatgttgatcttatccactttggcatgtaaaattgattgatacaagtaagctaatcgctcaatggataatattacaaataaaaatatcgaggcaataccagtatttcaatgtctggccaaataaatagtttagtacagcaatttgattaacgttaaagttactctcctctttgaataatgtcgtggttaaaaagtaaagtatttgtttatacattaagtgaagaaaattaagacgcgcctttctttaatgtaacgccaaaaattttcaagagatgagctgaacagcatcacaaaactactatttccagcggaagaaggcatttgaagcgtcctgattcataattgcgattttatttatcaaccagatgtcttataaattcggcaaacttgccattaataaaagtgagctatgtctagcaaatgtgctacaggctggccaatcctttcgatggatttgggatgaaaagttaaaccagtacagcactacaatgaagataggccagcaagaaaagtattcagtagtgattttgaggcaagatgaagagaatgagatcctggaatttgttgctgtcggcgactgtggcaatcaggacgccttaaaaactcatctaatgaaatattttagattggacgtgtcactgaagcacttattcgataatgtttggattccaagtgataaagcatttgcgaaactttctccacaaggcatccgtatcttggcccaggaaccatgggagacattgatttcctttatttgctcgagtaataataacatttcaagaattacgagaatgtgcaatagcctttgctctaatttcgggaacttaatcacaacaatagatggggtcgcctaccattcgtttcctacaagtgaggagctcacttctcgagccactgaagccaagttgcgtgagctgggctttgggtatagagctaagtatattatcgaaaccgcgagaaaactggtgaaggataaagctgaagctaatattacttctgacaccacataccttcaaagtatctgtaaagatgctcaatatgaagacgttagagagcacctcatgtcctacaatggtgtaggccccaaagttgctgattgcgtttgtctaatgggacttcacatggatggcatcgtccccgtagatgtccatgttagtagaattgcgaagagggactaccaaatatctgcgaacaagaaccatctcaaagaattgaggacaaaatacaacgccttacctatctcaagaaaaaaaatcaacccagagctcgaccatattagattaatgctttttaaaaaatggggatcatacgctggttgggcccaaggtgtcctattctctaaagaaatcggagggactagtggtagcactacaactggtgctataaagaagagaaaatgggatatgataaaggaaacggaagcaattgttacgaaacaaatgaaactgaaagttgaattgtctgatcttcacatcaaagaagcaaaaatagattagcttaaaaagtcatagtaaataccacgataaaagcacgcgaccgaaaaggcgatacatattccttaaaggagcttgaaaggtaatgattgaaatattagagatattcacagtataaaacacaaatatttagaacgataaataatacagtaaaaaacaatgcaatacctaaatctatctacaaaaaacggtcaccaaggcgttggaagatagaaatctatcaaatactatttcttctatgtaataaaaactcaggaacttgagaattcaaagtggtttcttgtgaaccaggtatatatggcatcttgtcgtcgtcaataagcccttgcaaaaagatacgaccatagtctacacccacatgataaatttcttcgaacttgctaaagtctaatgtggcatattcttcaataggtggtctcacataaacgacacctggtgtatttttcgctttctctaaagcatttactgatgcgacgtaacccaatcttacttgaatctctgccatattgggtatgtttggatgagaagaaaatggattccatctattgaaaatgatccaaaacccatttagggagtcgccatactccataggcgttctatcatctgcagaacctacatctactgcaaatatagtttggcaaccacgcgctctcatctcagttactggtaaattatcaacataaccaccatccagtaacatagacccgttctcttccaaaggaggtaaaagaccagcaagagacatcgaagctctgatgtacctccacgcataaccaaaggaatgtatttcttgaaccgaatcggttatattagtagaattacaataatactggatccagaagtcttcaattcttgtatccccgaaagttttccaaatacctctattaaattcgtgaccagtagtataagaagtaaccggccaggttaaatctgttaacattctccatatagaggaaattcgaccagcaaacttcttcacgcggccgtaaattggcaccaaatcataatccttcgcgtacaaaccgccaacaaaggaaccaatcgatgttcctccaataacgtcgaccggaataccttgctcttcaatagcttgaatgacacccaaatgactaatacctctcgcacctcctcctccgaggacaagtccaatagcttgtccagaaagaattctagccaatcttagaaaatcatttttatgcctatgaactggtgtgtaatattgtcttttacttttcatgaatcttgaagaaaagttttctacggtgttcttgatagaatctggaagtagttttgatatattctgttgagtttttctactgaattctgtttgaatcaacttatccattaatgccaaggcaccgttattcaaaacgtgcattttgccttcgttcatcaaggttgttcctgtcaaactaaattgaatgtgatgatgcgaatgaacccatggcctatagcgtaaccacttatgggttagtcctggttccacatacctttcagggtgtagaagaattaactcggtccttgcggtagtctttgaatttagtaataacttttcatattctcctatttcggctgatggggatctagcatctgctagtaagagaatacaatcaccttgcgcaatacaggttcttgtccaattagatttaactggtgtatctgatatataaacaacagtctggtacatttcttctagttcagcaaagtaaccactttgttttaatttggacaatctgtcaaatgcatgacgacctaaatgtgttagggtagttctttgatttaaaccaatcgtggtccttcctacctgtttgaaagcttgcactaacttcatagcaaatgcttctacaggtagtccactggtaattggtaagatagtgatggttctgaaagtaattgtcccagaagtaatattttggggtttatgacttaaagagctagagtaagacgctttcgttggaggtattaaagaagtgaagtcgttttcctttatagataatggatcgcctgttaatgctggaacagttctatctccgacaatttttttagcaactaatctggaaactctaatcatgatagatggatgttcaagagctaatagttcgaataatgttctcggaattctcgctaattcagaatccctcactgccactatcgttgaatatctattcatagcggtaagcacttcaacttcaccaaaactctccccctgggccagttctcctagaataatgttctgagtttcaacttcttcggaacttgtattggagtttgacaatgactgctgttgtagctgccttagtctaccattcaggacaacataaataccgttagccgagtcaccttgtgaaaatagagtttcagaagccctcaagtgaacccactctaaagcatggtcgagctttaataaccttgaagatagcaatttggttaatgaatcagaaatccgtaagtagattaggaaatatttatcaaacaatctttctaaggttgcactagataaaaatccaacatagacatcgctcttggcaacgatattaacaaatgatttgtaaccaattagagaggacaagtagcccacaataccaccagatcctacagagtataacaaatgttgagtatgatgaggattttcacccttgtgtgaactttgacctgaaacctgctctggtttagacattgatgatactactgacgaggacgaatttgttgtcacattaactttcccggaaatgatatagaataggcctttaccacgagcgttctgctcaacaattgtggtgccatttttaaagaacttcaactgaatgccttgtgcaaagtctttcttgacatcttcgaaatccaaattgggtgtcaactcctctttgtaagctctaggtttttttttgtcctggcttttacttttattatgccttttattgctgataatgtattccttgggtaggattcttaacattgtcggttgagtttgaggagaggcaaatgatgaagctacggaaatgtcagatggtgtacagtgaggggacatcagaaaacttgcgttacttggacggcggctatacatttcattaagttgaggagagtttaaagaagacatatttgctatcgaagaagatgaaacggacatattgcttttgtttacacccaagtatgttaacattgcctcaactaaagccattcttaaagcagagtcctcggtttcttcctgggcagcagaaaaggatgttgtgggcagtaaattaggtcttggagagacccgtcccttcaaatgaacgggacttgggtggatatggtcatgaacagaagtattatccaaggacaagggcgatgtactaagttgtgcgttgcgcaattctggggacaaagaagaaaacttcttagagtgtacggaagcattgttactgctactcctagaagatcgcttatgttggttagaggtagaagtgttaataccgtttgatttattgcggttgttattatggattgggttgggtgacagaatatccatagttctagacagtgggacatttgacagtaaatcaccaggattaaattggtctcttgaacccagtacgacatgtctcgaacttggatggtgggtgaattctggtttcagtgaaagggaattcgaacttgtgttagcgttggcgttagcaatcttaagcgattgaatgataccatcagatggtttcgctttgggcggtttcttcaatttagaggaagcattactatttttgggtttcggttctaaatcagccgatccgctcgacttatctacagttttaaacttacgaataacggcctctttcaaataataaggcaattcataaacgatggatttatttagtaaaacttcgatatccatgatctcctttgttaaacctaagtaatcgtgagcagtttggaacgtaacatggtatagcttggtgagaaccatctgtatgatatgggaagcagaccgtgggtattttgcggttaatttggcaaacgattgaggtgggataataccaattgtgcagtctgtagccgcacgggcgacaagtttaggcattgaagaggggaacgttggaaagctgttggtggagtttgtcatggaatctgtgttggagaagttctgctctgatgagcagaacatattgttgaccgacaccgttgtgtctataggtgacgataactcagagggaaagttactgttgccatacgaggacatggaatgcgtgaataagtttaaaattctcacgagggaggtcagcgggtttcctggcttgactgtatttagcagttgaaactttcccagtccatttttcagatgaatgtaaccaacggattcatcttcttcatcgatgaggttagaagaacaagatttggtgtcgtagttatcaatgtcatcatcttcttcttcgtcttcttcatctctatcctggtcgtcaagaccatccgtgtcactgtggtcagtttcatcgccatggtccttatctgaatgatctacttcatgatataactgcagggtgccttcaacgacgatggcaaacccaatagtactgtccaacagtaaaatctcaccctcatccattttttgagttttcatattcttggtcaggtcatggaagactggtttttccagatagccaaagattttgatggcgctgagaaattggtcaaggtaagatgaaagaaaggtttcgttttcgttgccatctttcaatgaatgcttttttgagtctataatcgagcttgcacccgtggtagaggaacctatggcgggtggcgcgttggctgactgagtggaagctgcattgatattggcgctggagccagatttacctgtattttccagcggcaagaactccggggtcagcctcttgtactgggatagaattctctccttcatgatggtgtaagtcacaaagactatgacggctagggcaaacaggatcagccaaaaggaaagagtgaactgaacatggtgtaacttgaagaagatccacttcggaatccttaaaagcgataaagttgccagataccaaccgtacctgaagatcatacgagaggcacccataacaaagtaggacacaacccacgagaagttgaagagggatgaaagtgaccacgtctgcgcctcagaaataatctggtcggtgagacatgtctggaatctataagaagtataattactggaattaaagctggagccaagactgtttttcgtgttttggccggtattgttggtgttgttcgtagtgcaattcattgaacgcatgcaaaaactagagccaagcctttctattcttttcttgtttattttatattcgttagagttttgtggtgtttctttaacttaataaactttcgagaaaagtgtcaagtttcccagatttttaagatctttataacctgtaaaaaaaaaaaaaagaaagggtttaaataaaaatcggacttactcaaagggttgaaacgcactttaatataggtttttagtttcgggtaagaagatgtgtcaaaggtctcgaaaaggaaacattagggcaaacacgtaaaggttgccttcgtatctcgtttccacagcaacgagaaacgagatacgaaggcaactgattcccagcatataaaaggccatgaatttttggcgtttcctattgtcttttcgaaactatttctttcattcctttcctttcttgttcttttacttataagaaaaataatatacgtatatatataactacaaaccacatcagcaataaaaaaaactatatgaccatggaccaaggccttaacccaaagcaattcttccttgacgatgtcgtcctacaagacactttgtgctcaatgagcaaccgtgtcaacaagagtgtcaagaccggctacttattccccaaggatcacgttccttctgccaacatcattgccgtcgaacgtcgcggcggtctttctgacattggtaagaatacttccaactaagagtatgcttctctttttttttgtaggccagtgataggaaagaacaatagaatataaatacgtcagaatataatagatatgtttttatatttagacctcgtacataggaataattgacgttttttttggccaacatttgaaatttttttttgttacctcgcgctgagcccaaacgggctccactacccgccgcggtcgccattttgggaagtcatccgtcccaaaaaggaaatagccataacatgtcgttactgttttggaacatcgcccgtttcgcccgattccgcctcagcgggtataaaaagagatctttttttttcctggctgtcccttcccatttttaaatgtcttatctgctcctttgtgatcttacggtctcactaacctctcttcaactgctcaataatttcccgctatgcaaaattcccaagactacttttacgctcaaaatcgctcccaacaacaacaagccccttccacattgcgtaccgtgaccatggcggaatttagaagggtgcctttgccacctatggctgaggttcctatgttgtctactcaaaactccatgggcagctccgcttctgcctccgcttcttcattagaaatgtgggaaaaggatttggaggagagactcaactctatcgatcatgacatgaacaacaacaaatttggttctggcgaactaaaatctatgttcaaccagggtaaggtcgaggaaatggacttctaaagttcctttcatactcttttcttttctctccccatttcccactagttctgttcttttctgctcttagataccctccttttcagggactctcgtcctactattgttgtcattctcgaaacattctctcccgtgcattttcctttccctttatacacatatatatatatatgtctcttctacgtatttttgtatttctgcgtctttatcaaagatagtctataatacgtttgatacagctagatatcgctagcgccaacattgtccccctctcttgatcagtgctttttttcggcccgagacaaatgagaaaatgtcctaaaaatacctttcatcaagactcctatttttccttagaaaaaacatatatccaactggaacagtattaagccaattgctacgatacaaacaaaaggagatattccttccctcccatagagtcacacaggagccagtacttcttcttgaacccgcaatgtcttcagacgctataagaaatactgagcagataaacgccgctattaaaattatagaaaacaaaacagagcgtccgcaatcgtccacaacccctatagattcgaaggctagtacagttgctgctgctaattccacggccacagaaacttccagagaccttacacaatataccctagatgacggaagagtcgtatcgacaaaccgcagaataatgaataaagtgcccgccatcacgtcacatgttcctacagatgaagagctgttccagcccaacgggatacctcgtcacgaattcctaagagatcatttcaagcgcgagggcaaattgtcggctgcgcaggcggccaggatcgttacacttgcaacggaactcttcagcaaagaacccaaccttatatctgttcccgccccaatcacagtttgcggtgacatccatggccagtactttgaccttttgaagctattcgaagttggcggagatccggccactacatcgtatttgttcttgggagactatgtcgacagagggtccttttcgtttgagtgtcttatttatttatattctttgaagctgaattttaacgaccatttctggctactgaggggtaaccacgaatgtaagcatctaacatcatatttcactttcaaaaatgaaatgctgcacaagtacaatctagatatttacgagaaatgctgcgaatcgtttaacaacttgcccctggctgcgttaatgaacggacagtatctttgtgttcatggtggtatatctccggagttaaactctttacaggacattaacaacctaaatagattcagggagattccctctcatggcctgatgtgtgatctgttgtgggctgacccgattgaagagtacgacgaagtcttggataaagacttgactgaggaagacatagtgaactccaaaaccatggttcctcatcatggcaagatggcaccttcaagggatatgtttgtcccaaactcagtaaggggctgttcatatgccttcacgtatcgtgctgcgtgccattttctgcaagagactggcctgttgtccatcatcagggcacacgaggctcaagacgctggttatagaatgtacaaaaataccaagactttgggctttccctctcttttgacccttttcagtgcgcctaactacttggacacctacaataataaggctgccatattgaaatatgaaaataatgttatgaatatcagacaattcaacatgactccacacccctattggttaccagatttcatggacgttttcacgtggtccttgccatttgttggtgaaaaagttacagagatgcttgtcgcaattctaaacatctgtactgaagatgagctggaaaacgacacccccgtcattgaagaattagttggtaccgataaaaaattgccacaagctggtaagtcggaagcagctccacaaccagccacttcggcgtcgcctaaacatgcttccattttagatgacgaacatcgaaggaaagccttacgaaataagattctggccgtcgccaaagtttccagaatgtattctgttctcagagaagaaaccaataaagttcagtttttaaaagatcacaattcaggcgtgttgccacgtggcgctttatctaatggtgtaaagggtttagatgaagccctgtctacctttgaaagggcaagaaagcacgatttaattaatgaaaaattaccgccttcactagacgaactgaaaaacgaaaataagaagtactacgaaaaagtttggcagaaagtacatgaacatgatgcaaagaatgatagcaaatagagaaagctcctatttccactgtacatacttcaataagtaagtaagttgcattaattatctatttagaagctagatgctcctcaaatgcacagaatcatatagcgttttattaggtctgttctttattttagttttgttgatctctatgaaggtatatttatatgcaaaaataaacttttaaatatctatggatgcttactcaattgtatagacgtttttcataggagtgcaaattatggacaccaccttctaattgagcagaagcggttctgaattcaaatctaacttcaccattttgaacattctctttcaataaagttagagattcgcaaccaatgtcttgacaagaatgttgtaaaccgttgtacaaatatggaataaacttcttgatggaacctttgtctacgacagccccagaaacaccttgtgcaaccaagacactgtctgactcagagaaataacgagaggtagaggcattacccttgttaccggtcttttgcatggcgtcaatggaccccataccacgataagccttcaatctcttaccatccttgtagaagtattcacctggtgactcggtagtaccagctaacataccacccatcatgacggtggaggaaccaagggccaaagccttggtgatgtggccaatgttttggacaccaccatcagccatacatggaacgccaaattggttagcaaattgacaaacgttgtagacagctgtaccttgtggtctaccacaagccataacttcttgagtgatacaaatagacccagaacccataccaattcttaaaccatcggcaccggcagcaatcaagttagcagcttgttctctggtggcaacgttaccagcaatgatttccaaatctgggaaagtttctttaatccatttgatcatgttcaattggaaaacagagttaccttgagaggaatctaagataacaacatccaaacctgcttcgactaatagtcttaatctttccttatcagcttcgatagtaccaattgcagcaccacatagcaattgcttggtggtggcggatttagaagctaatgggtagttttgattcttcatcaaatccgctcttgacaacatggaaacgaggttaccgttatcatcaacgataagcaatttacctttcttggtttgttttaggatttcattaccttctttcaaagtaatacccttgatgccagtaactggatttttagtcatgacttcagaaacaaccaaagaatcatcttctaagaattgtatatcacgagaggtgactaacccaaccaacttacctggacacttaccgtcttctgtgttcaaaaagatgtacttgtttccttttattttctcaactttatgaagactgaagaaattttcagcccagccagaaaagaaaaaaaaataacagtatttacatagcaatgttagtaaaataagccacatattttttatcacatatattaagttcctcaagtgcactgcacgtcaattaatcacacataatgggctttccgaaaaaggtgcgaatatgatttaattcagagtaaaagttctctacaagatcgtttgatcacagtcagtagaacgaaagttattgatataaaaagttgatcatcatcttagatctttttcacaccttggaaaactttatggatgattaaaaagcgcattctaatgaaagaaacataataccaaaaattttgtctattataacataccagtaactgggaagccagagaaaccaaactttctcttcataaccttaacttcaccaacagtggtggttggagaaattactattggagaattgatgaaaccgttttcaaacattttaactttcttgaccatggaagcctgttcctttggagtacagttgtgatggatgaaaccaataccacctaataaagccatataaatagccatatcagcttcagtgactgtgtccataggagaagagacaaaaggagtgttcaaagcgattttcttggtcaatttggtttgcaaactgacagcagaagatgggaaattgaccaagcctggtaagaccaaaaaatcattgtaggtcaacccacctctagttgtggagtccatcaattcctggacagaaagaccgtccttggaactgtatgtcttcaaatgttctaaagcctttttgtaatccaatggagcagcactcatcgtaaaatgtttgttaggtttcttcaaagctatggaattggtccaatatcctttggttcaagcagcaaagaagaccagagaaaatgtaaaagccaccattttttcgtaaacaaatttaagcccaagaatttgagaaaaagagatgaaaaaatgcgatgagccaagcatgatttgaatcggatggattctcaactgatatttatatggctttttcagttttttttttttttttttttcttagtcatctcgaagagcaaaaaaaaggaacgaaaaagtgccacggcaaagagtttttcacattagggctgccagaaagaaaagagtaagcagatttgaggattaaaagcactagtgcgtccctcaagtctatcataacaattttatgtattgatggagtgtagttgttttttaaatagtaccattagctagcttcttgtaagatcaatgtacttttgtaaaggaatatgccttcttgatgaggcggaacctttaagagattttttcagttctgcaaaatcataccagacaaaaaatgacaattgtacacgttgaaacggaattatagaaggaaaagcacaagttattgtaaggaaaagagacgcctgttcaagatgagttctgctaaacctattaatgtatattcaatcccggagttgaaccaagctttagatgaagccctaccttctgttttcgcgagattaaattacgagagatcatacgctttactcgatgctaaattgtacataggttattccatagctgttgtagctggtttgagtttcttcttggataaaaaatttgagagagatcagattgttacgtatcaaaagcttttggtaggcgcatattttgtgctctcgctacttttctggtatttctctcgttttattgaaaaggggactgtttatgtgggaaagagaagaggtacaaaggaggaaatatatgtaaagacaaagttcgaaaagaacgaaccattatatctggttgagcttgttcagaaaaaaaagggagaaaactccaagaaggagttgaaggcaaaattagaagtgaataaggtttttaatgaaagtggatatttacagaacgatgcgtattttaagtggttctctgaacagcacaatgtcctcgacaccaaaaaaaatgaataaataatgtataaaacatataactttgcaaatgattcaaaaattcaaattttctctctctctctctataaacataaatatatatgtgtatattgtttttttctttttttttttttgaatgatattaagttatacgaatgttcgataatatatatgtatgaataaataaaaagtttttaaagtagccttaaagctaggctataatcatgcatcctcaaattctgttaaagtaggtccctcataaacttcattatacagcacgtcgtttggtactccaactgttcttgcctttagtgttgatagatctaaaagatcaggcttcaattccgcaatgctagtaacacctaatagtctcatagacatttcaatttcatctcttaaaatttcaatggctttttcaacaccattacgaccatagcatgagttcgcatacaagaatggtctacccaaaccaacacctttagcacctagacataacgctttcaagacatctgtaccacgacgaacaccaccgtccacgaaaacttccaacttatccttcaagttacgttgttccaggattggcatggtttcagccaggacttcaatgggagcccttgaaaaatctaattgtctaccaccatgattggatagaaccaccccacttacaccgatttctgctgctttgataacatcttcggtacgttgaacacctttgataacaataggtagttttgtctttttcttcaactcttctatatctttccaagtcaaagaggggtcaataaactttgataacgctctcgaagcaccttgagattcttctacattagttttcttcatcgcttttggaccagcctttgtattggaaaatttcagcttcatatctttttctctttgacctaaacttggagcatccacagtgacaaataatgcctttacacccagcttttctacatttttaaccaaatcatcagtgatctttctatcagagttaacatatagttggtaccattgaatttgtttatcagagggtgctgcttcaataatttcctcaggggaacatgaagccaaagtagatatcatttgtgggacttttgtcacaccttggccacaacctctggcgacatctttttcaccttctaaggggtttcccagtttacacaaagctgtagcagacacgtagaagggaacatccacatgagaacccaacatgtcagttgaaatgtctactttgcgtacatctacaaggatctttggtttgaaaaaaatcctatgataagcattatggttttctctgtgagtaacttcgtcgttagcaccggaggaatagtaggcccacgcttgtttagtcaaagtttgagaggccaagtattcaaagtcgtaaaggttaataatattatctagaggaggtagcagcgattttagttgttcttttctagcgatatcttccttagtttcaccaggagcataaggaggacagacaagttcaggaggcatggatccttgaaggggacccaattttttctcgggagctatatacttatcgatgacattaggagcatgtagtggttcaaaaatagcagtgacatctttcccggcgttaaacttgataacatcctgcccacctggatgatttggtaggaatcgcgttaagtcgtatacgtaaccattgatcacaacccaacaatcatcgggcttgttatgcttggcaacttcagcgggcgaaatcttttgtttattcatatccagtttcggctcgttgtctatttggccattatgccagtttagatacgccacggaactagtagcggctagaattgcaccgactctcaaggcagtccatgactgtgtgcgttttcttgagtcttgttcgaacgacttggattttggaacggtagaaccgtacgcgcggattgtgttcaatctagtcttagacgctctgaggatagcagcctcacagttcttcgagatttttagtaaaggtttgtattttagcattgactacttttgtttgctttcttctctatgcgggaactgtattagcgacataggatgtaagaatacgaaaagatgcaagaagattagtcgaccaggtacttatatattcacatactccaactgaaagtattggagatctaaggttcagcagttggttcttggcggttcttgtatgacattattattggtcgggtcgtagttctctcgaacaggaggagggggcaaggagatatcggcaggctttttgctagcgccttgtttgaaaagcgtgggggtaggtctccaagcgattattgaggaagtagtttcaagtattacagagtccagggcacaagggtcttcattatagagagagaattttcgtgaaaaaaatgggcagaatgccacatgttagcaatgcaacgacttgagtggggggtgatccttccgatgtatgcgtgaaagatctcgtgttgtgcaggaaagggaatcatttcggaaaaaaaagatgcaacaaggaggatggcatgtggatactacgttcttgcgtaatatcctttttgttgcctgtgttaatacgtgagcaacattttttgttaaagtaggcgatcaactattgccccctgatattggtagtaattctgctaaaatatcggctgagaaatggtgattctcaaataattgctgggattccactggatatggccccattcttagatatatggaacgtagtagaaggcctcttagaggctatgggagtctctcaagagaaaatcgacatttttacgtaatcattcgttcatttcactttatacgtcatgattcaatatcgtattactttatcaagtacccgcgtttaaacttcattaaatgactgcgtctcaatctttatgtcatcctccctccgcaagtgacaatgtactggtaaaataaaaactaactaactagatgatatttttagagttttattccaacgtttctcaataggcgatggaggaacagagtgaatataagaggctctgtggatttatggttaccggatttatttcgtaaattcttattgaagaatgggtgaattttgagataatcgttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacacttatattctatatatccataacattgtctacatataatccgagaggttacgacaacattcatataataagggtagtactgacactttattttgaagtaaatcaaaatagtcactctcggtagccaagttggtttaaggcgcaagactgtaatttaccactacgaaatcttgagatcgggcgttcgactcgcccccgggagatattttttttccctttttctccaggcctagtgaggtttgagttttgaacgttttatagatagatgtaaggtagccagaatgagcacttagcctttaaagtaaattgagtagagatacgtaaacagtcgtgataaatatgtaatacattgtattattttaaataggttaaattttctttttttttttccatttcattttcattttcatttcctgcagttatttttttttcttattaatctatatccatgtaatcgttagcgatattgttgttagtcaacgcggccatggcagtaccgggtgcttgtgatgcaattatactttgggatggtagaagatgatactggtgttgtataatactagcacttccagtaggactcgtgcctgttatgtcgcgattagtgttaccgaaataaccatgaatcatgtactcttctgtttcagaataaaattcagattcgttcagtaagcggctgttcatagtgtggtgcatactaaccggtttcaggggacatatttcgatattttttttataatgaatattattgtaggttgcagtattattgctgttattatgattatggttattattattattattgttgttgttgttgttgttgatgatgatgttgttgttgttgttattaagattagcacacccggaaccgaccgaaaactttgtacttacagaatctcgttttgttctcttcgatctttggtagaaagtgtgtgtatcaaactcgaaatggtcattttttcttttattcatgatcgtatcattattggcgtcgctgttgtatgtagtggcggcattgctaccggaattgcaattgtttgtttggaacgcagtattgtgttcatagtatgagagcatttcacgcagcacacttgagtcttaaattaatgaataaaagcagccaaccccaagaaaaaagagcccttatctgtttctgtcgcagtcctattgtattcttcctaactatataattttgtcaaaatgaaaaatataaaaaaaataataaagtcagctgagtggtaaagagaaagcaaagggagagaaaaatcggttacccagatggattaggttacccagatgtcatacgtgtatcatgatttctagaaattattaccctgtttggtaccatgacaacggatatggcaatcttgcattaagtaaaatgtctctaatgggaccgtgaaggtacaaaacagcaatggtctaggtagtggcattcgaagcttcgaaagcgtggcctcgcctcgagcgtgaagtcatattttctcactctgcactgccgtgctgtgccatgtagcccactgtatgcctctagcaccccaatcgggaaaattgtaaacattagcaggtgtcgcctcgaggcccccgatacatttttcaacatctcctcgatacttaaacagcaaacaaacaagcaacacccacgcaagaagatttattaatacctcttgactcccgtagatattgaagagactaagtatagtaacgcatatccgcacaatactatggttaaggtctggaatatagtactacgtctggtagtgttgctgtttttagcaggtaataccttgctgttaattttgatgattatatctggtgccacggaccattaccccgtgaacagattctattgggtgcagggcaatacaacaggcatacctaatgctggggatgaaacacgttggacgttttggggcgcctgtctacaggataaagacgggtcggatacctgcacaagcaatttggcacctgcataccccatttccccagtagataacttcaacacacacatcaatgtccctcaccagtttatttccaaaagagacgctttttactacctgactagattttcattttgtttcttttggattgcgcttgcctttgtaggtgtgtcgtttatcctttacgttttgacttggtgctcgaagatgctttcagagatggtgcttatcctcatgtcttttgggtttgtcttcaatacggcagccgttgtcttgcaaacggccgcctctgccatggcaaagaatgctttccatgacgatcatcgtagtgcccaattgggtgcctctatgatgggtatggcttgggcaagtgtctttttatgtatcgtggaatttatcctgctggtcttctggtctgttagggcaaggttggcctctacttactccatcgacaattcaagatacagaacctcctccagatggaatcccttccatagagagaaggagcaagcaactgacccaatattgactgccactggacctgaagacatgcaacaaagtgcaagcatagtggggccttcttccaatgctaatccggtcactgccactgctgctacggaaaaccaacctaaaggtattaacttcttcactataagaaaatcacacgagcgcccggacgatgtctctgtttaaatggcgcaagttttccgctttgtaatatatatttatacccctttcttctctcccctgcaatataatagtttaattctaatattaataatatcctatattttcttcatttaccggcgcactctcgcccgaacgacctcaaaatgtctgctacattcataataaccaaaagctcataactttttttttgaacctgaatatatatacatcacatgtcactgctggtccttgccgaccagcgtatacaatctcgatagttggtttcccgttctttccactcccgtcatggactacaacaagagatcttcggtctcaaccgtgcctaatgcagctcccataagagtcggattcgtcggtctcaacgcagccaaaggatgggcaatcaagacacattaccccgccatactgcaactatcgtcacaatttcaaatcactgccttatacagtccaaaaattgagacttctattgccaccatccagcgtctaaaattgagtaatgccactgcttttcccactttagagtcatttgcatcatcttccactatagatatgatagtgatagctatccaagtggccagtcattatgacgttgttatgcctctcttggaattctccaaaaataatccgaacctcaagtatcttttcgtagaatgggcccttgcatgttcactagatcaagccgaatccatttataaggctgctgctgaacgtggggttcaaaccatcatctctttacaaggtcgtaaatcaccatatattttgagagcaaaagaattaatatctcaaggctatatcggcgacattaattctatcgagattgctggaaatggcggttggtacggctacgaaaggcctgttaaatcaccaaaatacatctatgaaatcgggaacggtgtagatctggtaaccacaacatttggtcacacaatcgatattttacaatacatgacaagttcgtacttttccaggataaatgcaatggttttcaataatattccagagcaagagctgatagatgagcgtggtaaccgattgggccagcgagtcccaaagacagtaccggatcatcttttattccaaggcacattgttaaatggcaatgttccagtgtcatgcagtttcaaaggtggcaaacctaccaaaaaatttaccaaaaatttggtcattgatattcacggtaccaagggagatttgaaacttgaaggcgatgccggattcgcagaaatttcaaatctggtcctttactacagtggaactagagcaaacgacttcccgctagctaatggacaacaagctcctttagacccggggtatgatgcaggtaaagaaatcatggaagtatatcatttacgaaattataatgccattgtcggtaatattcatcgactgtatcaatctatctctgacttccacttcaatacaaagaaaattcctgaattaccctcacaatttgtaatgcaaggtttcgatttcgaaggctttcccaccttgatggatgctctgatattacacaggttaatcgagagcgtttataaaagtaacatgatgggctccacattaaacgttagcaatatctcgcattatagtttataaaagcatcttgccctgtgcttggcccccagtgcagcgaacgttataaaaacgaatactgagtatatatctatgtaaaacaaccatatcatttcttgttctgaactttgtttacctaactagttttaaatttccctttttcgtgcatgcgggtgttcttatttattagcatactacatttgaaatatcaaatttccttagtagaaaagtgagagaaggtgcactgacacaaaaaataaaatgctacgtataactgtcaaaactttgcagcagcgggcatccttccatcatagcttcaaacatattagcgttcctgatcttcatacccgtgctcaaaatgatcaaacaaactgttattgccaagaaataaacgcaaggctgccttcaaaaactgatccattagatcctcatatcaagcttcctcatagaacgcccaattacaataagcatgttttgctgttatcaccgggtgataggtttgctcaaccatggaaggtagcatggaatcataatttggatactaatacaaatcggccatataatgccattagtaaattgcgctcccatttaggtggttctccaggaatactaataaatgcggtgcatttgcaaaatgaatttattccaaggccaaaacaacacgatgaatggctttatttttttgttattcctgacatgaagctttatgtaattaaggaaacggacatcgaggaatttgcatcttttttagatgaaggagctattcaagcaccaaagctatccttccaggattatttaagcggtaaggccaaggcttcccaacaggttcatgaagtgcatcatagaaagcttacaaggtttcagggtgaaacttttctaagagattggaacttagtctgtgggcattataagagagatgctaagtgtggagaaatgggacccgacataattgcagcatttcaagatgaaaagctttttcctgagaataatctagccttaatttctcatattgggggtcatatttttgctggtaatgtcattttctataaactattcggcagagaaaagatgcaaaacaagctggattcattatggtttggtaaagtttacccacacaacttgaagctgttatgtgaaaacttggaaaacggtaaaatcatcgacgaaatgtacagaggtggcatatcgatgaattaaaacggtttccttttaaaacagaaataaagatgaggtgaaattttatatttcttatatttaaagctatcatatattccttgtacatatatttattaagaaaatacattaacacgcctttatacttggtattattactgtaaaatcattacatgtaatttgttctgacttcgttgattgtttgaattatatcctccacttgtacactctttaaatttttggccaaaaattcctgctcattcaaggaaagtctcaggaaattttcacataaatcaccatcaataactttacgtacaggggcataatagcttctgtattcttggtggtctctacctaaaatggaacaggaaccctcacatattatttcatcctctataccatgccgtccttgtaacacaacacttccagattcctcttcatcgtcttccttacgcatattgttattcttctttcttgattcataatctaaataaaacgtatcatccgcctcagccattatattctcaatgtttcccatcataaaaacattccccttggataataaggggataaagcatcccacggttccttgtaagcccatatagatacaaccaggtctatcagaatttgaaaggctgtccaggatatggaaatcagtgatgatatcattaacaaagaagtggttcagtagttgaaacttgaacttgcaatcataagtattgggtaatttctgctgtaaagtgatgacgtctagtgggtacttgatggccccattagataattcgctgggatcatgatttgacatgattttttcgcactctggtggagaccttaaagtccacgcatttccatatctatcagcgcctataacagttgcctcatctagaaatttcaataccgtcacatggcgttttacagagtcatctacgtacggaataaatacattccccgcaggatcccagataaataaagtgacagattcatgtatatcaccaacggccagtctttcataattccactggtgcatagacacaatttttgttatggataccggggtctgtgttacggaccttcttaataattgctttttccccaaaccataaaggacaatagtggagcccatggctgtcagcaagaagtttttaaacttcaacatagcatgtattggtgaaatgatttctgtttggtgaagtaattcaatatcaaaagatagtttatctttgttaactaatatcttgtatgttaacagccttttgtcgccagcacaaatgatcaaatgatcagcttgtcttgtgaaatctattatagcagcggaaacgcaatcgatatcgtccagtatcttgtataaatgatccgaactgccaaactttaagcattcaccatcaatttgcagtgatatacggcattgtttcttaccactgtgattatcaataaacaaaatgcttttcggattattgggaaatgataaaatagtacgaggtcggaatgtagatatttgtaacatttccatttcttcttccatttcatcttcttcctcttcattgctttcatctcctccaccgttctcttgcttgttaacacttgattcatgaacgtgaaaccagttatccaaagttggaaagttggaaactctgccaatatttaagcgtcctgagctcgatattgaacaaacaccgttgattgcaacatctgcgttaacaaatttggaacaacttagcatgttttgatcctttaactgccgtatggtccacacatttttccacgtgtagcttacccatgtagaagaggaatggcaaaccacgcatgacatccatttagctccactactatttatttcttcttcttctttttcatcatcatcgtcttcttcttcttcttcttcttcctcattatttagtgatacagatatctcacgcaaatacgaaagggaaacaggcttcaagccaaggaatcgcctttttatgtcagtgaacgatccgtcaacatcccctatatgaaatttcatgtaaacgccattttctaaacctacatgcaaattaagctgtcctattgaggaatctctaaccattatcatgtcagaaatcttttcactaactaattgcaaacttattacagttaaaaaatcttccttttggtctttaagagacattattttgatcataccctcattgtcagcaatggctaataaatcagcatgctgcgtatcttgcacaatcgcaactttagagggcattgtgtccaattctgggtgggtggttaattcgattaacgaatccgaagatacatctatcttgaaataaaccaattcgtaatttgataatgatataattagttgtgttttcgaggacgtggcacatacaatacgaattcccgctggtggcacccaagtcagcttattagaatacctagatttaccagtcggtacgatatgtcttagttctgcggtgcatacttggataatagagtgtgagcccattaggcatgtatgaattgttgtgtcctgagagagcttgaaagctgaacgcgttgcttcatccggtgttagttcctccatggactcgttgtcaatttgtagtatcatagttttcttgggaaaagttatgaacaaaagagtattgttatcgccggttgttgcaggatcgggtattagccataacttggttgcgttcgggggtaaactagtagatatcaaattagagtaattcacagcatttgttaaagttattatcttgttgtttgtaaaatgtttagtggcgatagacagtggcgaatcactgacaatttgagattttattgaagggttcaaattcaattgttgcgataatatgctcaaattctgcaactttatggatggttcgaaaactagcgacttatttggatcttttgaggttaaaacattagaaaaatcatttttctctacaccaagtttctcaaactggaaaagaaagttgttattcatttcagatagtgcaaaaagataaccgtttttgaaaatgtgtaattggtgtgaattttggattgtatcaaagtaggacaattgaactaaaggtctatttctatcattagtgtctggacttacagttaacttaaaaagatcgccatggttagattgtaaaagtacgaaaaaatcatttttcaatttctgcactatgcctgatatgattgttacatttttatgacggctatttgtgatagatcttttgggtatttccactttcaggctgaaaaatccgttcatatcctttaccagaatatgattttcgaagcctatgacaacaaaagggttgaaaagggtatcatagtcagcatcatagttgttgtcgcttagcgaagttgttatattatatcgcgatagatctggcaaactcagtacgaaattggcagatgggttaactaaataatctgccttcttgacgatgtgattcaaacccaactcgaggacataaaatatcaagtgtactgatagttgagtagcggcattgtcgatttctaaggtaacaaaacatggattattgaaatttacatcaacaactgccatatccagcgttaccatatggggtctgatgatttccaatggagacgaaatcctcaatttttgagcataatcaacgaggaaacacaatttattttgttcgacagatgagagaatgatacaacgcccattagggtcaatttccatgtatgatatgggagagactcttcgaagggtggtcctcgtcaatggctggttcactaaagtcttaagtctaagagcacctgcatgcataatgatttgcacgatacttaggttaccagaatcggaagttagcgctagaaaagtgggccagttggaagcttttgcccttgaccctgaatgcggcagatccagcgacttcatcgaggttatcgtcgcaaacaggttttgaaacttggcaataagctttagttccccatctgcagtatcataaagttctaaatgcgtctcagtagctacgcacaattgcgactgctcacgcttggaccctgcttccagatcgacgaagtgtccgatgcaggagtgcacgaaattcgtctgtttctttaaagtaagatggtacaagtatagctcatcatctttagcaaccattgttatgttatggtcactccttgttcttctttcagcctctcgttttaaaccgtcataagccatcgttgtgctagcttgcccaaatagtttacgcatcttcgccgtgtggggcgacaagcttactactgccattttgccacctccccacatttaatgatggaaaatattataaaaaagcgagaaaagaagctaatggtgccattgttttcctttttagagaggggcagcagagatcggtggactttgttttgatagagggcgattgcaagcatggagatttacattagacttaacgcagatgtcgagcacgactatgcgtttcaggtgtcaaatgaagacaccataaataacaaaattaagaagattttcccttccaagacgggtttggcggacttaatggtgctgagaccatcaattttccatgagaaggagcccgtaaagttctataagtctatccatccagggtacctgtccgaaggtggttgtttgatgttccattatgaagctgataacgaagaaaatctcgaggagttgaatgactccaagccgcttattgaccagttgtggcctggtcagctagttgttccggagtggaagctatccaagaaaaacatatgggtatacaccattattatgttggcctggctatataccgatttgcccgacgccatttctccaaccccaggtatttgtttgactaatcaattgtctagactattgattcctgtagccaagcacatggatttacctgaaattgccgctaaactcgaacaagaagttcaggcaaactattctagtctcgtagctcaatggcttttctttgtcatgcacattttcaaagtgggcataattactttattcctcaaattaggcattgccaaccccatcagcttcaatccttacaagttatggagtttgagagatttaacttctccttctgctaacggcgctaagaattctggcggcaataacaacactactgacttaaagacacgtttgcgctctctgggctggattggtgctaagagagctacttacgacgattaccagactaactattacaactatgtcatagataagatgggtggtgcagttgctgcttatagagcgggcgcgattaggaaagctgcagcaccaggtatccaacttgtggctggagagggtttccaaagtcctctagaagataggttcactgcttccactttcacggctattaaaaccgaacggaaattcattttaagtgaagaatactttgtggagctggaaaacaatctaaagaagatcttggaagagtatgacggggatattggtaagatgaatgctgaaattaggaggtttagaaggtttggtatttatgaaccagatgaaaaactggcctcgctagttaagctcagaagagaaattgctgatgagaaagagaaagcatcaaacaatgatgctacttttggtataaaaaagaatgatttgaaaaaatctaattaattgtaaaaccaaaacactaccatccagactttttttttattcaaccatagcctttaactactactactactactagtactactactattactattactattactactactagagggcctttttttactcctagtatttttgtactatcctatttactctcgttgtttttattagttttttcactctttttttcaattcctcacgaatctactgttttcgtagtgcttttttttgtttcattgtttatagccatcaatggtttttgttactatcattatcattataaatatttcatacaatatatacaatatatatacaataaatgagaatcgatttacttttaatgcatttttgcagtcaaaaaaagcttcgtttacatttatatgtatttatgtttgtatttctgggggaaatatgcctttatgggcgtatatactctttcgtacgtttctacatccgagtagcagtagtaactcggtattgtgctttcgtcgccataatcaggactatcataatcgaattttttttgcgttttgttgtcaccacatatggtcccttcttcctcatcatctatcaatattcccaattcgtagacagttctacttaaattctcgtcaatgactttagacacatactttcgtagtttcaattcataccccttaaccttccttttactagacaaaaatctcggacgtataaaaatgatgaatattattatgcttagaattaatttgcttattaaaattacccatatgataaacgagaacaacatgaaggacaagatcacactttcttcgtaatttgtcttagcaatatgttttatcttgtttattattccatttaggtcatctaaattacctaggctttgagtactatgggttccgctactggtctcattcgaaactgtcagtaaaactgaccacaaggttaatccgttgattatttgccttggagagtcaccgaacaatagcctcaaacatccactgatttcaaaatatgaaaagaataaccacttactgaattttttctcatcagtcagcactattagttcgaaaatttgatactttttgaaattgaacaagcaatttattaatctgctaatgccattcatgtagttcgatgtaatctctttcttcctatacactctcaatccaattaccaactcccaaattaatattaatgaggagcataatatgcatccgctaaacaaccattttgaaatacggaattccaagaatggttggatgatattgttcgaccatgtgttaaatgccagtaatttaatacacgtgtatatatcagaaaaaaacatggccacatgtagtatcgactgacaccaggtgtatagaatatactgtaattttgtggtccacttcgcagtaggaataagatttatgtcaatatcctggaatttcaatttttgtaaacttgattccattatttagcgctttgttgtcattttcctttccctcttagacaatgtggtaaaaaatgccagctccagggctttcaattaatccattattgatttttaatctggaggtttgagcatggctgaataatttatatacaaatatctttttttattgtttcagatcattcgttttcagtatgatttactatcattcattttctttttctttaccattttacgtcgccgtcgcacatcttaaaacaaatttaatacagagttgaaagtttcagacttaaacagaatttacgcaagaaagttttcaaagtcctaaagtaaaaacgcgccttccacagccatttctttgttcaacaaaaagttttggcccttactgctattggatacttggcaatccgtctttcgttatgccagatgaaacaaattttacaatagaagatattgagcctaggcctgatgcccttcgaggtttggacacccagttccttcaagacaacacagcattagtacaagcatatcgtggtttagactggtcagatatttcttcgttgacccaaatggtagatgttatagagcaaacagtggttaaatatggcaatccaaatgattcaatcaaattggccttggaaactattttatggcaaatattgcgtaagtaccctttattgtttggattttggaagaggtttgctactattgagtaccagttatttggtctcaagaaatcgattgctgttctggccacctcggtcaaatggttcccaacttctctggagttatggtgtgattatttgaatgtgttgtgtgttaataacccgaacgaaacggattttattaggaataattttgaaattgcaaaggatcttattggcaagcagtttctatcacaccctttttgggacaagtttatagaatttgaagttgggcagaagaattggcataacgttcaaagaatatacgagtacattattgaagttcctctacatcagtatgcgcggtttttcacatcttacaagaagtttttaaatgaaaaaaatttgaagacaacaaggaatattgatatagttttacgaaaaacacaaacaacagtaaatgaaatttggcagttcgaatcgaaaatcaaacagcccttcttcaacctgggccaagtgttaaatgatgatttggaaaattggtcgcgatatttaaaatttgtgacggatccttcaaaatccttggataaagaattcgtaatgtccgtttttgacagatgtttgattccttgtctttaccatgaaaatacgtggatgatgtatattaagtggctaacaaagaaaaatatatccgatgaagtggtagtggatatataccaaaaagccaatacgttcttaccactggatttcaaaactttgaggtatgattttcttaggtttttgaaaagaaaatatcggtcaaataataccttattcaataacatattcaatgagacagtatcgcgttatttaaagatttggcccaacgacatattacttatgacggagtacctttgtatgttgaaaagacattcttttaagaattccttagatcaatcgccaaaggaaattctagagaaacaaacatcgtttactaaaatcctagagacatcaatcaccaactacatcaataatcaaattgatgccaaggtgcatttacagaccttaataaatgataaaaacttaagcatagtcgtggtagaattgataaaaactacatggcttgtacttaaaaataatatgcaaacaaggaaatatttcaacctttatcaaaaaaacatcctcattaaaaattctgtaccgttctggttaacttactacaaatttgaaaagagtaatgtaaattttaccaagctgaataaattcattagggagcttggggtagaaatatacttgccgactacagtaatgaatgatattttgacggattataagactttctatttaactcattcaaatatcgtcacgtatgaatcctccattatagattcaaatacatttgaccctatcttgtaccctgagctgaaaatgtcgaatccaaaatacgatccagtattaaatactacagcaaatgtagattggcataaaaagacggaatggaaggaggctggtcacatcggcataacgacagaaagaccgcagatatccaacagtataattgagtgcaattcaggaactttgattcaaaagcccatcagtttgcctaattttagaaacttggagaaaattaatcaggtcaagattaatgatctatacactgaagaatttcttaaggaaggtaaatgaaattaatcataaatcataaattatatttaaaataataatttactcggccggaccccgaaggagtacccaaatatttacttgtttataatttattattgaaaatgttttattctatattggtagagttaataaataattatataataaattattgtatgataatataaataatagtttatgtaatattttaagttattatttataataaaaaagtaactattgaacctgttaaattaaaatatattcaaaaaacattagaggttggtaagattctattaaatcgcagaaatcaaataatatgaagagtaaaacaggtagatgaaataaatttattattaatttagtttacgtaaatcgaaatgacaggccttttctgtgttttttgatggttatataatcagaaaaatttgataaatattgtttatatgtaaagactattaatgattgtttctatcgtcaggatattttgaaaacgtccaaatatgtaaaacaacttctaaacattaaatatttttggtgaattaaaaaaaaatatgcgcaagcccggaatcgaaccgggggcccaacgatggcaacgttggattttaccactaaaccacttgcgcgatctttattggtatttgttggaacatagagttaactaaccatatataacaacttcttaaatgcacagtacagtctattcaaaactgtagctatgcgctgcatcttgtggcaaactcgaatggaattgtgggtttgctaggtctctgtccatctgtaaacaatatttcccgggaacgggcaacaaaggtaatgtttatatgctatgttctttattatcaatatgcaaaatattactctatgaagtataaatatatgtactgcttatatacatgcatgctttttaattacacttaaaaacaaaaaatgttttaagtttccctagttgaaaccaagttattaaagtttactagtttgttcactcacttgagtcttcatcactgtaatgcatttcgtccaacccgttgtcctccggcgataaatccatcagctgcgtatctagaaattctgcatttgtttcatacacgtctccaaaagagttttccactgaactgttatcaatgctatcatatacgttggctacatccctctcttgaatgtcttgtgcttcgccgtacagtcttgactcgaagcttttcagttgattttcaattaatctgctagggacggcaaacccacctttatctaagcaaatttttaaaaacgttctcacgtagtgaatatgctttataacctggttgatctttatgtctctatccaaaccaattaggtcattatttttgttgtcattgacaaattgcctcgacaatgtatcggccttcaataaatgacaagatgcataaatgaaccaaacttcagcgtcttccataaacggaggggtcaatacccattctgatatcttatcaatcaattcttgtagtaaatcgttttccgtatcaaaaggtttgtcaatgatgtttgatgatggttccatagatttttggcaattaattaaagaagaccaaaggtacgtgatagcaaatttcgcagtatgtgttctagaaccggtttgaaaaggagggacaatggaacggtaattgatgttctgaacaaatcttgactttgacgaatagatttgacacatccattgtaagaagtcaagaccacttgatgaatttgataaattatccagtatttcaacgccaatgccccaaagagacttgatttgcacccctgggatccttattaatgtggcgaatattttatatgcaagcgaccagttatgtcttgacacattcaaatgcaaaaggtcggttaatgttactatatgtcttgtgcggtagtttctgacttctgatgttgatgtttttaatggctctaaccctctagatatagattggaagtaaagtttattttcctttgtacaatgcaaaagtggaatttccattttccttaaaggaatcttttcaatttttttaaaattatgatacgtcattttttgtttgttaatgggttgtttattttgtgaggacactgttcgccaaatttcgaaactcttctcaggtttttcgtattttttccaaaattttctctcctcatcactatcttccttgtctatcccggtgtcatgttcgccaccttcctcagcttcctcctcttgagagtctgtttcgctttccgtagtagagtaaatttcaccgaccacactcctccaatgcctttctcttcttcttttcttctgctgtaatactgacctcctatatgcgccgacttcactgttttgaccttcttcttcgtcattattttcagctgcagaattttcgggcgttggcaaactatctgtggtagtagatttcttggaaattctgtcaaatcttctagaaatgtaatttatgtattgatactttaactttcttctttgagcaaacttcctattagttaaagttatagggacttcaaacatggtttatgcatcatattagaatttaattctaactttattcgtgcttcaatttctttcttctttttctttaaaacacttttttattgaagaattctcaagtataacccactcaaaaatataattggcaatgaaaatataacttttttagatgttagcgatgctatttcatctgagatgagatgagatgagatgtttattatgatccatttctttttcttttttttttttttttttttttttttttttttttttctattttttttcatttttcaacgcgggtaatagagaatacatctattgtccgggtaaattatgttacagttagcgcttaatgttcacttcacagtattatgagctgttcttgtaataaagacgactataacataacaaaaaaaaattaactctcgctagaataaagtaacataattactaaaaggtggctaagcaacatatcagtccgactttttcacctcttctcaacgctgtttcagagtacatttaatttccgccatatactcgaataagtggctaagggagagtccaaagagcgtgctaccaattcttcatctcgttaacaaactggctctccattaaaaattgtgctatatgttctataagccaactctatctatatcttttcttttagttctactttggatactgttgccaccattttagattgcctttccttttgccgctagccttacaatatttggcaaacttttttttttttagccgccgagactcttgatctatggccgggcgaaagggcaaatgactgcttatccccgccatcacttccccccgcccaagggtttagaattggggattaagtaaaaacgaatgactattcctctcaaagtcatccttgttcgacaaaaagaatggaatataacatattggaacaatttcatcctcttttccccattttcgcatataagagcaactaaacgccggtgagtaaagtgcccttccctacagactcttttactcaggtatatatatatatatatcccttaaaaactaaaaagaaagcactcatgaggatctgtcattcgagaactctctcaaacttaaaggatcttccgataacgtcaaggagagcaatgcattcggccattgtcaattactccacccaaaaggcccaatttcccgtagagacaaataatggggaacactattgggcggaaaagccgaacaaattctaccagaacaaaaggcccaattttcaaggcattacctttgctaaacaacaagacttaccatcattacccgtgcccgaattgaagtctacacttgacaagtatttgcaaaccatccgcccattttgcaatgatgtagaaacttttgaaagacagcagctgttatgtaaggacttctcggagcacatggggcctatcttacaagaccgattgaaagagtatgccaacgataaaagaaactggatggccaagttttgggatgaacaatcctatttacaatacaacgatcctattgttccatacgtctcttatttttattctcatatgccattaccgaatcatttatcgaagatcgataatgatcctttgattaaggctactgcgattatctcaaccgtggttaaattcatcgaagctattaaagatgaatctttacccgtagaaattatcaaaggtatgccattttgtatgaatagtttttcattgatgtttaacacttcgagattgcctggtaagccagaggataaccaagatacaaatattttttattcagtttatgagaacaactttgtaactatcgcttataaagggaagttttacaaactgatgacccatgacgggaatgacaaaccgctttccgaaaacgaaatctggaggcaactgtactctgtggtattccaaggatcgcagtccgatcccaaactaggtggcattggttctctcacctctttacctcgtgatcaatggcgtgaagtacatatggagcttatgaaggatcctatttctcaggattcactagaaacaatccataagtcttcctttatgctatgtttggatcttgaccaatcccctgtcactttggaagaaaagtcaagaaattgctggcacggtgatggtattaacagattctacgataagtctttacagttcctagtcaccggtaatggttcatcaggtttcttagctgaacactcgaagatggatggtacgccaacattgtttttaaataactacgtttgtcagcagttgaataaactagatgtggatgacttcatgagaaaagtaattacgccatcatctacggtggcaatgaaacctatggaactgcccttcattatcacaccgaagattcataaagcaatcgaatctgcccaactacaatttaaggaaacaattggtgagcatgacctacgtgtttggcactacaacaaatatggaaaaacgtttataaaacgccatggcatgtcacctgatgcatttattcaacaagttatccaactggcggttttcaaatatctgaaacgacaactaccaacttacgaggctgcttccacgagaaaatacttcaaaggccgtactgaaactggtagatctgtgtccaccgcctccttagaatttgtttctaaatggcaaaatggcgatgttcctattgcagaaaagattcaggctttgaaacattctgcaaaagagcattcgacgtacctgaaaaatgctgcaaatggtaatggtgtcgatcgtcatttcttcggtctaaagaatatgctaaaatctaatgatgaccaaattccgccccttttcaaagatcccttatttaattattcttcaacttggttgatctccacatctcaactatcttcggaatattttgacggttatggttggtcccaagtaaatgacaacgggtttggactggcatacatgttgaataacgagtggctgcatatcaatattgtcaacaaaccagccaagagtggagccagtgttaacagattacactattatttatctcaagctgctgatgaaatttttgacgccttggaaaatgagaataaacgaaaagcaaagttatgaatttttcacctttcctcttcaattaatttgtgaatatttttgttaagtatctacacttacatacgtataaataggggagaaaaaagggcttacgaatacatactgatcattactatctatttctgcacctagtttcattatgcaatttaaaacaacttacagaacaaatcttatttccacaattaacgcaacttgaaatactatcgtagccaccgcaaatagagcatgtcgtaattaggggtaaaactttgaagtatcgtttattgtaaacattgtggtaaataacattcttatccatcaagtttagcagcgcagaatctaaaaacgaatgtaaatttctttttgaacttaaaaccttctttaacgccacaatacgattggtattcttcctctttggtttaggtagttttgtagatttatacgatagttgtatttcccgtaaggtttctggtttaagcacccaaccatgaccatacttggagtgctcttttacaaaagaagaaccacccattaatgcagagagaccatcagaggtctgtgagatcggtttggttgttgattcaattctatctcgtggtacgcctgtgagatcgcttaataaagtcggtacatttggcaaatctgagaaattttctgtgttaagttccataaacctcctgtccgactggagaatctcttgttgtgtgtacctttcttcaaatgaatgggaattcttactatttcggtcatcctgtctgcttatactattgccatctccctcagatctcgaagtatataacctggcctctaaatctgccagtgagtagtttatgcgctttacgggcctagaggtggatattgtgccttgcttattaatcttctttgaagtatatcgacgtgcttgaggatccaaagacgtgaaatatatgtcagggttgtaagttttcttatcaatctcttcaactagcgccttcatttcgctgttatgagtaagcgatccgttctttttcttcgatctatcaatgatatcgacgttactatagattgaaagggccgcttcgacttttgttaatactcacatagatcatcatgttcattataaaaaaagtagttaagattaattatctattacccggatcaaagttatttctacagaacacaaatattttattgattgcttcgttacataaagcaacgactaaataaaaataagctctctagctattccaccgacttcacttccttaatgaatggtcgtttttgtaatactccaaaaaaaaatatcaaaaaaaggggcgagctgggaattgaacccagggcctctcgcatgctttgtcttcctgtttagtcaggaagtcgcccaaagcgagaatcataccactagaccacacgcccttgtgaacttgtgaatcttagccactaaggaatcaccgaatagtaaaagttttctgacaactattaagcccttaacaacaataatgaatattgagtgcataatgttgaaatggaactctaaaatatcatttgtttagtagtattcgtgttactagtatagtacctgagaaatgggtgaattttgagataactgttgggattccattgttgataaaggctatagtattctgtatagctgatattatagcctcaatcaacaatggaatctcagcaatcatcagatgaatgttaaaattgtgtaaggatgctcattttgtttcgttaactttccagttttctcgaggacttctggttcattatacgtgaaattatttacctaaccaaaattatcaaacaattcttccttacttcagctaaagattcggcgagacagaggttgaacacaatgcaagcgcatcgatatttttacggccgcagttgaatggatccaaaagcattggccaatttaaatgaaagaaataagtaagtttctaaagatttatctaagtgcctcttctttcctgtattcaataatttagtgtctaaaacgcaaaggtataaatttgataatgttcttttattaactgtcaataaagtatatatgaaaaagtgtgaagaaccttcgtataaaatctatctagtaaaatatttttaattatgtgcggatgtattgtctattcccatgtgctttgcttatgtcctgttagaggacttttaagtatgctgtatacatgttttaaatttttgcctttattctttctctctcttactatatcgctctcagacctgctgggatgaacgactaacgttttgagcaatcatatcaagctcatactcttgatttgttaggtcgacactaatagaatatggtgcgattttcttgcttcctaactgttcgaagtcttgaaatccctttaactcgttacgattatcttgtgtcgaaactgaatgatatttttgtaatagatcttgcttatatctgaagtaattataatagcatacatctgccataataataagcattcctaaccaattgtaaaaaccacttaatctttcagaaagaataattataccaaatattaccgtcaaaagttccttcactatacccacaatagatacggtcagcacgggcgtttgctccaaaatactaaactcacaaattgtcaacaaaaagactgcaaaaccaggtaaaattaacaaaacaatacccctcacaatggataggacggtagtttccgtgccgacaccgccattgctcgtatcaagcctaaatatgctagagctgaatataccaggaaatggtttttccacaagtagcgaggtaagcaacagagtaatgcccattataggagctaactggtggattgtatgaattgggtgaggcttggattctccaaaattctccagcattttgttattggcgaggttaacaacaggttcattatcgacattgtcttcattttccgtgaaaagggcaccatcagattcctctactgctgcagcggtgttagtttgaattgggttgttcctaagcatcaactgcgtataaacccaccttaacccagaaagacagctacttgctaggacaagaaagctgccaaaaatgaccaaggcttggtcatttttggtactggtggaatcgcttggtttgaaaaccattaatgctacaccaacaaacataattattactgaaagtgccaacttccaatgaaacttttctagcttgaagatacagccgaataaaaggacaaaagctatgctcgaagatttgataattgtataaattgtcaagggaacatactggaaggaaacgttactgagcccgatatcacctgcagaagcgactgccgtagggagtaaaaattttagaaaaaaactccagttaaaaccattattctttcttaaaacgtttttcactggcttatgtctgagcttaatgtatatgccggatagtaaccataaagtagcctgatggaatgttgtcaccaacacgggatacccaatacccaatccgtccttcggatcgaacatccatctattgtatatggagagagctattgaacagaaataccatccaaatacaaatgccaaaaagacagtcctattcatagcaaaatgtgacacgagaattgaaggtataaacactcgctgtaacaacttcaagtgatcgtggaagtgatgaaaatgcagttatgagtataatcaggccaattgacactttaaaaaaacagaacaacagcttctcgtgatgccactatcccttatatttccagttctaagccatctccttctcattctcgacaaaaaaaatgggtgtgattattttgcgctttattttttggcgtctcgtcgccgatgactctaatagatgttgaagcctacaagcatctattatattttcttctttggttgtaatgggatgaatgaatctagagttaatgaaggagtgctggcaatgctgggctcgctggatggatgataattagattgtgcaggtacctgttcaaatccatcaccatcatcatattcactgcatccagtgttagtaactgcgggctcgtgtactttgggttcagcttgttgatcactcatactctcttgctttgattggatggtatttttatcactgaaagttgtatcatcgtcaggtgataggccagatttttggcttacctcatcctgaatgtcatttttggcctctataggcttttcggatttcttttttgaacctgatttagaaccagaatggccccaaaatccaaaaaaactcttccttttcgacttatttttctttgtcttatcaccgtctgatttcttcttttctttgggcaattccttaacaacgaatttctgtagcgggtccactttgaaatcggaattagcccacgtagaaggtttcttgccatcagctgtatgtgcctcatttctctcaaatctttcttccaccatccaacttttgctattgggctttatacacttatcaatctcagcagaagctctatcaaataactgactggtagtagtaattttgggcttgttgcttcctctgctcggagagccctgcttgaaggttgtatttatagtttcttgatgagaagtaggtgctacattatgactccaggaaaatagaactggcccatccagctgtaaagcgccagaattcatagttatggttttttcctcatcaatccaatctctttgtatttgccgacatttcccatcaagtttgtcggtactcaatttattccccatttgcataggtgaatgaaacaaacagttcatcaaccgcctaccgttcgctacttcatctaataacccatataacgacacatctccatttttggcttgctcggagtcatcttgcggtgtgtattccttactgaacaactggtcgattattttgttttcgttcataatttgtccttcccaaaaaataaccagcttagattctgacaatgcttgtttctttaattgatgatctgtaatattcgttgatcattaataccattgatttcaatatttcatgtttaatcttttgcgcgaaaatttcaattgcaaaccaaaatatacatcaacaatcttttatcggtcaacaaatttgtcgatataaccaaatatacgtcgtcgctgcccattatacaatcatcatggtagtatccatcataccgcaatttcctgacatcaaggtttcactagcattgtttgaacaggttaaaaatgctaaagaaatacgctctaaaatgagtgaattgtcgacatcctttgcctttattgacccccggttagtctgttcgggggagcagatgtattctgcaatttacaagaccttaatagaagtgaaatataacaagatgagaacaagaaatttgaattccgagtgcgtactatgtctttcacccacttccaatattagtgatgctttcctcaaattcggaatcaaagacgattcgtcacagttaatatgccttaagttccatactaatactgacgatgtagacgaagagcaattgaggacgattatgacttctatagtaaaaggacaagagatcgagtttaatgatgacaatttatcgagattttatgacgaagcgctcataagaaaagtatgttttaatagtaaattcgaggtaaaaacttcgacatgcctcacaaacaacgcattgtactaacttcacctttgttttccttttattttgtttttacctattagatctataaattaagtgatgatttcaagccccaagacgtaaatggtctctcaagagctttggtagacgctattcaattgaggggtgtgtagataagagatatctaacgataaaattataaaaaaaattctttaattatttttcagattagtattatttgttctccgtgaagtcagtgtatcgaactggcaaaagttctccttatatacatgtgtgcgtataaccatcacttttcttcaatggttcttttgaaattggcaaaatgattaactaattccaattcagttgataatgtatcgtatctgtagttaattctaatatcaggaacatttgttctaaccacatcgttaccttcaacaccactcttgtcaaaatctttccctatccaatgttttttgatttgtgcttcccacccactttgcaacacggaatttcttgccaattcacacatatctacattagacaatttataaatttgtgctgcaactgagtattcttcgattaatggttctctggtatatgagaattgtaaaggatcatctgtggatagtgagacattcaaacctcttttaaagtatctcggaaatgggtttttatcataggtcaaaaataatgcgttattagaaaggggtgacattgcgataccaacctgatctaaatagtataagtattgaacaaatggaactttcctcaataaaataccatgtgatataccatgtgccaatagatatgctgaaacgagatgctcggggtcaccggcttcaccacaatgtggtctcaaaaccaaagtgttaaaccctctcttagccctccattgattcaaagacgcgacatttgaatacaaatagtacaggtaataggaataaggagggttttgaggagcctcccagagtgatggcttgggatatttcctatgaaagcggcgatcaaccttggattcatcatcgacagaatcaaacccaattactctctgtaaaaatacatgcaattttggatgagactgaggatttttggtcacttcaaatagtggctgaaacagattcttacagatgtcctggaagctttgaacaatgccagttttcttgtaaatatcatataacctcggaatttggactaaccaacgaacattatgggaaataactttgttgtcaatcacccagctggctagtttatcccattcatcgagagacctgccataaacagaaattctatactcacagttttggtattttgaattctctaaatcgaatatgacttgtttggtaatgtcagccaagtaggtacccttgatgtagttgtttgtcttcaaaaaaatttctctgagacgagattcaccgatagggttatattttaagttgaatttatcgaatctgtggaatgtatccttatgtgcatgcatatctaaagtatcgatggataaatcatatccagtcaaatgcaaagaacggaatacttcgtctaaagttagtagtttcccgtccctgaaaataaccttttcatctttggaatgtctcaatttgtgtttaatgaaacgtaataagtgcttttgattcatgcaagcagaatggtgaacgtgagtgtccactttcctaacattataaaaatccctgtgtgggtttcttttggaaacgctagtttcttgatattcgttcaagagatagtaaagattccagcgtgcctctaggtattgcagccttctataagcaaatgatttagcgggaccgtctgatgagatggaaatcattttttctagatccagatagtagtcacgaagggtagggatttgagcaattaactcatccgtcttacctgatctgtgtaccacgtacgagtcgtcatcgttgagagtaaattcccaatctggatcctcaccaggaatttcacatttcgtaaaatcgaaaacttctgcatccggcttgtttgttactggcacaacagtcttagtgtctgagttgtatgaaggtttaggtggtggtggatagactacccagcctggcttgttttttgggttttgatcatcgttttgcacagatatggtctgatatttggctctcaaatttctacactctgccactttggaatacaagtcaatcaactcggaagagggatcatcaagaaactgctgtgaagcatcatcagccaacattcccattttataggaggcagaggtacgtacctgcttattcactaccggagcgccggcaaatgacttgagcgtctctggcaagatatgctgagcactagcagacaaggtcctcggtttacccccggaattttgagatgcatggtctgccgagtcatggcccttattcatcgctgctatgttggaagagctacaattggtagaatgcgatggttgctccaagatggcagagtgagaatcatgctcatctagggccaactgtttggtgccattttccaacaactgctgattctcgtgatacgagaaattagcattccgagaatcagcagctaaactttcgtgtgaatcttgctgctctaaggggggtgtctcatcatccactacgacaccagcttgttcatcaccaatctttctttgatctatgtcaatgactagtcctgaaccatcttgttcatcgtgtgaaggagctggttctagagaaaggtcgttaagcctctgtgtagcctgattgtccataatttttttttagaatgtcccctttttatttgttatataatttattaatctggcgtactagcagttcaatcgagttttgctgaatcaaaattggctatagcagggagactataataaaaatactattaaaatccgataattgactagtatacgaaaaacgctgctaagtctgcctgtagagagagagaagaaaagtcgtcaagagatgccttttttttttttaaaatttatctattttttgataatatcctttaaaccttgtgctactagaactcctttctcatcatcgccaggcgcaaaaaaaagatgaaaaaggaatgaaaaaagaaaagagaagaccccacgtgccctaaaaataaagttagggcatttataaaataactaggatatatattgatcaccctgaacggaaatcaagggttttaaagagccctcaaaattactgttttaggaagccccctttgtttttgttttggtttcaatttgtggtggctaatctggacatcgatctacttgtatagctgtcaatatactatgcggaatacatggaagagaaatagtcctcagtcattattaatagtagagtgagaccatacggagtgaacgtagaggccagaacaacaaacagtagaacggtagcagtactcagttagtgccgcgatgaatagtgacttggagtatttagaggacggttttgatccgaattcaatgaaagttgcgactttgaggaggatattggtagaaaataatgtcgatttcccatctaatgctaggaaaaatgcgctggtggggctgttcgatgaaaaggttaaaccacagatcccgcagttacggaaaatgtatctgaacgttcggcccagcgatgaaggtattgtgaaaatggaccgtccctcatcttccccatctatagcttcccctcgtagaagtagacgagctcgcagggagaaatctgcttcccccatggccaaacagtttaagaagaatagaatactggatgatgtaagtaatgatgatgatgatgatgatgatgatgatgacaatgacaatgataaaaaagacgattctttaattgtacctagtggaacggataccgatgaagtggacgatgaagaggatgatgtgataacatcaagctccaacaaatcagacaccaatgatttccagcaaaattccgatactcgtaagaaaaggaaagaccctgattctgacgactggtctgaatctaattcaaaggaaaataaaatcgataataagcatttgaacctcctatcatcagattcagaaattgaacaggattaccagaaggcaaaaaagcgtaagacgagtgatttgaaccaagagcatggaaatggctctgccattttaggaaaactttccgtcaaaacaccaataaagaacacaaatagaaagccagtaagcatggataattttaacgattcgttgacttcaagcggtacggaaaatgatccatttgtaccgaacatacgacacaatccaaaagagctcggaactgccaatggaacaggccatagcacacccttgagtaagttaaaagtttctgcctcatttgcggataaattgcctcaaaaggaggtaccatctacaatactggttccagaagtggaacagcaagaaccttctcagagtgaaaaaacaccgtctttgttttcttccgaaggctctggctcagagtcggaagcacccttgcttccagagatcaccacgccaggtcctcatcagcctatggataataccagcaataatgtggtcgaaatgatagatacagatagtagtaacttggtatcggatgaagatgaagttttagtacctacaaggatcgagactccccaattacccacagagaaagacgtcgaaaagtgtgaagcaagagtgcaagaacttcaagaggaagtaaatgagcaattagagcatgaaaatgggagtgaatttgatgttaagcaaggatctgggaaggtcgggaacaggcataagttcaaaagagcactcaaatttttcagcaaatcattgctggcgctatttttattttgcatattcattgtaattcctctcttatttggcctctggtatagagagcaaagactgctcataggttactgtgggcatgaagtaccatcccatcgagttagtggcaattccttcgagtttattcaaaaactggataatttgctgcaggactacagaccgaaatgtatcccttgtccacccaatggtatttgttatccttatttgaaacttaaatgtaagccagattacaagttagcaccatctagacttgactttttggaaattattcctgcacaaggcaaatgtgttaaagacgacaaaaaacagcaattagtttccgaagtggttgaaaaatctttagagtttctgagagccaaaaatgcacaaatttcatgcggtgacggaaaagacgacatcgagagtggtatgacggaagatgccctctatcaaatatttaatgaggctagagctccttggattcgcgacgatgaatttgaggacctgtggatccaagttatcaaagatttaactgaagaaccagaaatattatggaggcaagtgagtacaatttattaccttacaaatattattaaacctgttattatatgataacagttttaattttttttgaatttttttttgtttttgatttatttactaacatcttttcctaattttccctagttatcacccactgacaacaacattggcggaaattccaacaacatcattaaaaccaatgacgttccgagacagaagagacatcttccagaaaaattcatctccaagacgaggaattttcggtcgacgtccaagaaatacattggaatgaagtgtcgatttgaaagagaaatctaccaaacgtataaaaaatttcaaaggccaatatggctaatgtttttactgatagtcattagtaaagtaatcgagatcaagctgaagaattattatagaaagaaggcaagaattgaagaactcgttactcaaaccatggaaaaattgaaattccaaaagattaaatcaatgtccgatccgaaagaaaacgcgtatttgagcatagttcaattgcgtgacatctttctttctgatattgtcgatctgaaatacaaaaatcaattatggtcagaagtggtaaaatatttagagcataataacagtaatattaaatcgaacttaactgaaattcgaggtgaaataatgaaatgttgggaatggataggtccgatggaactcaatgaacctaagaattccgctgaaaacaaaatataacccacaaaatgaaactcaaacgtagttttctcttctcaaacttaatgatctattgtttttccgagttgccatatttgtatagtttattctatttatacggttatcctaatatctgttatataattctttatgtaatacttttgtaaagttataatgaatctaatcctgaaaatgacttgtaaaataataagaattttttattcgatttaaagtaaatattaatacgacacatggaggaaagaaaaactagacgatataggaagaaatacaaataaaatcagaattgaaagagtaactagaggattttggagtaataaataatgatgcaaattttttatttgtttcggccaggaagcgtttcaagtaggcttgcgtgcatgcaggggattgatctttggtcttccaacttctcttcgtgtcgatctttgttgcggaagggctggcactgcaccatttccattaggatgtactaccttagaaggcggcgcaaaccgtggagcagctgcaggcggaaaagctgtagcgttcgttttaattggtgtggtttcacgcggtacttgattcccagccccttctggcatatgaggccccagttctttatcattgttcttcatgctcaattgttttccctttggtgcaaatttttcatagacagaatccctcgcggtggtcatcgttttatcttttagcacactcgctggaacatgcttggacgtagtctgatcaacggtgtgcctaatggattgtgcctggtatttgggatcaaaaatgctctcttcaccaatataacgttcattttgtacggaagttgcagccttagctgtaacaaaggtgatttgttctgcctctgggtttgagctagcagttgggctttgcttagctacaacgggatccttctctgtcgttaaaacattactgtttgtgttgcccatatttatcaagtcgtcgtcttgaaaatcatcgctaaacataagagaatcatcgagaaggtcatcttgatcctgtttggaagcatcgagagatttgagatcagtatctttattactgctgtttttactgttagcctcagcaggtgcggccatcattggggtacctcgacttactgtattttctattttcaccaggttcttcgtcgagtcgggattggtatttgtaactttagtcaattgccttcttttattcgggtattgttgttgttcttgattttcatgcaaagtattcgttcttgagctttcgctgatttcatccgttggcctaaacaaattgttttcgtcaaaatctggcggatcgaacttcaccttatcgatctttgccagaaaatctttatcgtaaagacaatttcctagagcattaccaaaccctctcaaagatcttttcaaggcatccgtaacggcagatttcttggccctttcgaaagcggcaggtttccgtctttcgttctccacggtaccatacccaatatcttccctataagtcccgctagtcaacgtaacacgaacaattgcagtacaccctatgctaaactttccctgtcgctcatccaaaaaatcgataactacactttttacctccgtagaccagccattatatccaaagatttgattagcaagattaattactctccaaccttcgatgtatgcaatcctgcttgttccaaacccaactctcttggagatatactcaggtcctaatttcttgtccaatttggtctgtatgtcctcggaatggttaccgaaaacgggcttcttctcatccatatccataatttcattcatcaacaacacaccaaagtcaccagaaccttcagcagttcttgacaacctccttgtttgcatttgttgattctcagtggcaaaatagcttaaaaacgccattcgataccggtcgcgtaacccgcccgccgctatatttttcgtcttttcttaacagattaaagaatataataacatcgagaatcactaacgggaagagcagactctttggcgatgagtaagtgtgattgagaagacgaaaggacattacagggcaagcagatgatacagacgccaagggagttgttgaatccacggtacacgtaccataccatctttagcgacgtgtgcaagacccgattcaaccatttagttacgaggttgtttttcatatgttctattatccaaactgtggtgatttcactgctggcgttgccacactcaccgttatgggaactggcattggcatttgttcccaatattttagctcttaacctagtttcccttttgatcattgtgacaagaaaaaattacatgcatgtaaagaattttgggttcgctaattcacttactttcattctaggccaattgttatcagtaaagtttcttgtataccagggagtctatagcatgggcagcatccttttatcattcgtactgggtgtggttttcggacgtggcggatctggatggaagccatactataagctgtttatttggctagtcgttcccacgatttacaacctacaacatcatgtcactgacgctgacaaattgtcgttcaactgcgaaaactttttccaggccccacaagactacgtattagagcgtgtcaagaggattatggagaagtcagtcattctaagtgtaatcagcatgttcgtattaccaatctttaccacagtatttttttccaggcaaaaatcgggattatttgattcatttacgaatggcgtgctagctgtcacaaatttactaataatctcctgcattatcttcatcactttcgaattcataaatatagcatttgacgcacatatgtccataggttgtctgcacaagggcaagctaatttcgaatttgtcgtcgacgccgatggaaaccctgcttagtgggctttctgcagacaagccatttactaggttgactgcctaccaggaactagcgtatagggccacttcactggatccatcattgcgagcaccaatatatcactccaagttcagaagcagtagtggtaatacttggtcattaatcctcaatgaatgcttgaagaccattcagataaacaatgaaaaggttgtgcagtacctaagatcagtacaagatcttgggggctctgcaactgctagacataaaaaaaaagtagaaaatctagattatatgtatgagaacgggaaactaacaagcgccaacgaaagactcttcgggaaccgaccctctatgatggcgccattacgggataacggcttattagatgaatcgccaaacaggctgagggtaagaactgacgatagtgtattgcttaaccgcggaaacaagaaaaggcataggtcctcgtattacgacaacgatttagatgaaacgacacaaacttttaacggctctattttcacccacgaaacaacatttatgactgctatgcgtctgatgttaaaaaaactgaaaaattctataatgtcgtttatcttcccttcctacgcagaaagacaatcatctgatgaaagcgacaattacagactattaccaaatggctccaacaaagcccaaatctcgataattgacatatggtccatttccaagaaaaggcaagctgagaagctggttccattgcccatatgccacgcaaatagtgtggtagcactgacaggactgctgatcagatcaaagacagaagatccaaaaggcggtataattgcatccgttggggatattcttaagactttggagaggtccatctgtgcactgggtgaatttgccgattgggatccggaatcgatggcatacactgccttccaaacacaaaggacagcccaagatagagtacaacaagacagtgaagacgaagatagcatgaaagacactaccgacatgatcagtgttctttatcagctgtccactagtgcttttatggagattgtacttgaatacaatgttgctctgaacgacgtatatttggatgcagacgtggccgagttagcgaactggtttctagaagtgtacgcctcaggcaaccctaatgctacgtaatacaattcaaccgaggagcacccctcctcccatttcatgtaagataaatacaataataaaaattggaataccgcacaaatgctttagtagaggcctaatatgagcaaaaagagcaaaaaagctacctttatcgtttccgggtagcgaatcaaggagggcccttttctgcttaaagaataatagtaaagaaaagtatagagaagagaagcaatggcttcctatcggaattaattcaattcctggtactagaagcgataacatcacagttatacgttcaagatgtcacgcatgccatctagtttcgatgttacggagagggatttggatgatatgacctttggcgaaaggattatataccattgtaagaaacagccattggtacccattgggtgcttgctgactacaggagctgtcattctggctgctcaaaatgttcgtcttggtaataaatggaaagctcagtactacttccgttggcgtgtgggtctacaagcggccacactagtcgcactagtcgcaggttcatttatctacgggacttctggtaaggaactgaaggcgaaggaggaacaattgaaggagaaagccaagatgagagaaaagttatggatccaagagctggagagaagggaggaagaaacggaggcaaggagaaaaagagccgaattggcaagaatgaagacccttgagaacgaagaggaaatcaagaacttagaaaaggaactaagcgacctggaaaataagcttggaaagaagtaatttggctcttcgatttgctgtaaataatttatgatgagagacaaaagaatgaacagctaatttcgactgtaatgaagaaatgtaataaaaaaattcatgatgctatgtccagtatgcaagaaaaataattacaaaataacagcgtacatatgaatattctttgtttttatcttgtataactatcacttaaaacatatttatatcgataggtaaatgctatatcaatcgctctatttacttgatttttaatatgtgggtttttttttgcttgacacatacgtaacggtaattgccagctaacgatcggtacaattttcagaaaaattgaaacagagagaatccaccaaatattcaattgcaaggtgacgtacttcagataaacactttattgtaccatattaagcggctatataaagtgtcatatacacccttcaccaaatacgcaacatgtctgaatatctagctcggacgccctgcaaatttactatatggtcaagcgagattgatcttatcagaacaaacctgttggtgaacgctcaccctttaagcacggttgggcgactacttcaatatatccattatcaaatatacaaacaattaagagctatctatcaaccagaggaacagtgcacgaactcggaaccacctcacacacccttaaatagtatcaacacttacttcctaagttacgaaggcagagagttatctgcaacgtgtttattaaaaaacatcacgtcatctagccacccagattcgaaccatttcataagactacaactggaaaagcgtacttctccttccggttcagcatttgacttggaatatgatatggagggcgaatttaactcgatgaatattcaatttgagataaatacactatcttctcaacgtatattcaattccatggaaccaaatttgcctattggcactacattggctagattagagaaactggcattggaacgtataaaggattttgaaaaatcagcagggaatctctgtggtattaaagaggaccattcagtgtctgatttgcagggatttataataaaggggaaacagacacccatgtttttaaattatggaagtgattctgattactataaagacttgaacctggtagatttgataggcattgattttgctccggcacacaattcttttttcacatttttgttcaagatgaatcacgaacagaattcacatatcgccgacgatgaagagagatttgtgttggaattcatatccgatgccacattatctataactcaaatgaatgttaagcccgataccacggtaaaacaagtgaaagatttcatatgttctgtttacactcactcattaaacttgaggagaaatgatatcaagttgatttataagggacagttgcttcatgaaaataattttgcaggcaactcttcaaagatcagcgagtacattaaagagccacatgaagtgaaggtccatgtacaaatcaaccaagagtatacagaatctgggcctggattttggaatgaagtgttcaacaatccgaatattttccaattcatgcctccagatacaaggtcacagtcacctgttagtttcgctccgacgcaaggacgatctcctgctgcaatacgtggcgaagaacgaggtataccatacgtaaccgaatctggaaatgacatcgtgcccacagatgagctttataggaaatgcattatcaacggggatgaagtagtattcattcctgttagcgaactaaatccacaatcgagctatttgtccgtgatcaaaggcgattacggtgaaattaaaatccccatatctagtaatgactacagaattaatggcgataatattttgctatcaccatctgcgatagagcagttagaatctgctttgaacttcaaaatcgagagaccacgggtttcgacactcttgcatccgtctggtgagcatgttcgagctgcagataatacctcctcggcaaatgataataatacaattgagaatgacgagtcagcgtggaatagaagggtagtgcgtcccttgagaaacagctttccgctgctattggtattgataagaacattttacttaattggctataattcattggttcccttttttattattttggagtttggaagcttccttccctggaaatatatcattttactaagcttgcttttcatttttaggactgtttggaatacccaagaggtgtggaatttatggcgagactacctccacttgaatgaaattgacgaagtcaagtttagccagatcaaggagttcatcaattccaattcattgaccttaaatttctacaagaaatgtaaggacactcaatccgctattgatttactgatgatacctaatctacatgagcaaaggctatcggtctattccaagtatgatattgaatacgacaccaacacccctgacgttggacaattgaatttgctatttatcaaggtgctatcgggtgagattcctaaggacgcgctagatgagttgttcaaagagtttttcgaattgtatgaaacgacaagaaacatgaacacactatatcctcaagactctttgaacgaattgctgctgatgatttggaaggagtcccaaaagaaagacatcaatacgctacccaagtacagaagatggttccaaaccttgtgctcgcaaatagcggagcataacgtccttgacgtcgtactcaggtacataattccagacccggtaaacgatagggtgataaccgctgtgataaagaacttcgtgctcttttgggttacactactcccctatgtgaaggagaagctggatgatattgttgcacagagagcaagggaccgtgagcaaccggctccatctgcccaacagcaggaaaacgaagatgaggccctcgtaatccctgacgaggaagaacccaccgccacaggtgcgcaacctcatctctacatccctgatgaagactaattgcaatgcgatgtggccacgttatataatgcgtttaaggtgtacgaaaacccatgctgttctggcccgtcgggttttctgacaaattgtcctttagggatttttcggtttggctcgggttggcaaagtcggctggcaacaaaccaggacatatataaagggaggtaattcgtcagatcaatgccgaaccgttctcaacgggccttcccctcgttcaattgctcacaaccaaccacaactacatacacatacatacacaatggtcgctcaagttcaaaagcaagctccaacttttaagaaaactgccgtcgtcgacggtgtctttgacgaagtctccttggacaaatacaagggtaagtacgttgtcctagcctttattccattggccttcactttcgtctgtccaaccgaaatcattgctttctcagaagctgctaagaaattcgaagaacaaggcgctcaagttcttttcgcctccactgactccgaatactcccttttggcatggaccaatatcccaagaaaggaaggtggtttgggcccaatcaacattccattgttggctgacaccaaccactctttgtccagagactatggtgtcttgatcgaagaagaaggtgtcgccttgagaggtttgttcatcatcgacccaaagggtgtcattagacacatcaccattaacgatttgccagtcggtagaaacgttgacgaagccttgagattggttgaagccttccaatggaccgacaagaacggtactgtcttgccatgtaactggactccaggtgctgctaccatcaagccaaccgttgaagactccaaggaatacttcgaagctgccaacaaataagacgcttgcagagttgtctaaatgactacttatttaaaattcactctttacgtttatacctatctatctatatataaaacccataaacttaatgctattcactgacaaaacgatacactaccgtctaagaagctattcacactagctcagttctaataacaatcatcgtctggctctaaaacgcgtaaaccattcactgccacactcactttagctctgttgctgcccttcatacgctgagacgcgacgcttcttttctttcatatgatttcccttctaggcgacacgccatgccccaaacggggaacaccgcgaattccttctggtgcccggtttcctctttgggaagggcgtcaaaatggtacagctcgctatagtcaccaattactgcagatgcttaaaggcttctgcaactgtatgtccaacctaatacgtggaaacttcaaacgcgaacaatctgtatgctgtttcgggctacttattgctctatacggtttttagtggacacgaactcttgtaattattatatatatatgccttagcattttaacaagactctatgttgtgatttcagtatgatttgggtgaaaacacagtggtgaccacagaacaacgaggtaacagttccagaccactacctttccccttcaatctttgtgatttgatcaattcttgatgtcacaagaaacaaaaatgctaccttctctatctagtcttctatcgggaaccgaaatctcgtccagccccgtatcaccaagcttcactaatccaagaacgagttttcacctcgatgatcgcggaaccataaaattaccaccgctaaacaccagtatcaatcgtccaagatctgtggaaagcgccttgagacacactgttacatccttgcatgaaaatagcagcgcttatggcgacgacatgctcaagcacacgcaatcagactcagccctctcatctcagttgaatagttctcaggaaacagttgatgaatcacacgaaaaccttctactgactcccctaaatagcaaaaagagagattattcggtttcttcaaagaaaaacgacatattaacaccactctctgcagcgaggtcgattattatcccctctgcctctaaggaaaaaagacgtgcatttgctttcatcacacactcgcaggagaccttccctaagaaggagcctaagatcgacaacgctccactagcacgccgaaagagaagaagaacctcgtcccaggaactatctattcttcaggctgaatttgaaaaatgtcctgctccatcgaaggagaaacgaattgagttagctgaatcttgccatatgactgaaaaagccgttcaaatatggttccagaataaaagacaagcggttaaaaggcagagaatcgccacttcgaagtcaaccactataatacaaacggtatctccaccatctccgcctctggacgttcatgctacgccactagcatccagagtcaaggcggacatacttcgtgatggaagctcatgttctcgttcttcctcttcttcaccgctggaaaatacgccgccaaggcctcatcattccctaaataggcgctcatccacaccaagcataaagagaagccaggctttaacattccatctaaacccacaaaagaagacgttgactcccgtgaaaacgtctcccaacagcagagtaaataaattgatcaatagcatagatcattctccatccaaagccaagcgtccggtaagcaatccctccggctcccctaaaaggaagagaaaattcggattcaagatcgtcgatcaacaaccgttgaaggatcttgatccgaacgctttccgtggttgatctaatctctagtcattatttattcgcaaattcatttccctatacggcattcatacatatcattgttcacttcagtcctagcatatatcataaaatatacaattgttttctaattaccttacgttttttaaaagacttctataatacctcttttaactttacatgtagtcaaaataaagtgcagttccatcgatggtactttctcaccccggttgagtgatgttaacgatgtttaccgtataaaacttaattatattatatctttttttgcttatatgttatacatagaataaaaagttgattaaacacacattggtctgaaaacacgtgtagtactttctcctttgaagaataaaaaaagaaaataaagataataaaaacgaaaatagcgtacaattattactgataatttccttaattgatttaagctcttcttctaccagtggtcttggtgtgttgacctctaacacgtaaaccccagaagtgtctaataccacggtgggctctgatcttctttaatctttccaagtcatctctcaacttggattcgacgttgttagccaaagtgtggtagtccttaccatcagtaatgtcgttttgacggtttaagaaccaggctgggatcttgtaatgagttgggttttgcatgatttggacaattctttccaattcttcttgggtcaattcaccagctctcttgtgcaaatcaacatcagccttcttacagaccaagttggagtaacgacgaccaacacccttaatagtggtcaaagcgtaaacaattttaatgttaccatcgacattggtgttcaacaaactgattgtaatgggcgcacaaaaaattgtacatcttattgttagtaatttatttcacaccactgctaggttcttcgagaaattttcaacatggcgcatcattttggaatggcgtacgaacatggagggacgataaatatgaatttgtcaagctgtattgactgaaatttttaaattcgcattgagtcatatattgtattttccaataaactgtgtattactttaaaatctagtgataatttttatagtagcgtagagttaattcggcctcgtatttggtaacccgtgacgtttattattccatcggagtgcactcacatattttcaatcgcaatattaagctattatcccatgtaatgtgaaactctctcaacatatctgcactgtactcgtaaaacataccgtaaaatgtgttggaaggaaccttgttcttgtacaactaaagacatctttaccactttctgctctattggcttttcgtaagatcggtttttcactaatagtatatctttaacaatgttaaagtacctgatattgttattactaaggaccttttccagttaggatagcaaaggtgtcagaattaccatagcccaggcatcaaccagtttccgcgcaagaattctcctcctcccggaacaagaggcctgcggagacgagttctttgcctctgaaaggcgaatctctggaaggatgagcttggatggccccagtaaacgcatttgcctaggttgagcagagctaggaggacaccccgacggataatttagcccttttccaatttttcaaaaaaacatgaaatttcaaaaaaatgtatggatgtaaaattcagtagtgtgtacggattttacagtttcttgaatgagacttgcttttacgtcaaatcattctgaattatacaattctttcattgtgagattgatatttcatggacttattatttacagatttattttttacgtatgtagatggaataataactggatggggtagaagaaggggtcacttgtatgtctacatatgaaaatcagttagacacggagtgaaggatttctttctgatgggccattgctagatattcaagagcttccaattcgataaaaacagcttgcgctcttagtatgtcatttacctcaacaagttctttctgtataacatctactttttgtttgtatggatcagaactctttatcagcccttccctagtcttgtctgtaatgaaaagtaatctcttacctttaagttgaaattcctccaagaattttctgaagatgacttcgccctcaaaaatctctttgccctcaactgtgtttgtattcacaagatccagcctgttcaagtcgagttctggtgtgggagatattaagtcgaccttttcaccaccaataacaaacaactttccacttttatattggtggctcaaagcgttgttgaaagccatggaataaaccttggatggtagctctgtagtatagtcgtttggtgcagttcttgccaatgccctaccaccattatgtcttgttggagagttagcatccccgactcttgccctaccagaacccttttggggcatcaatttacgtctggaaaacccgttttcacttctcccgggaggatttgaggcgcctactcttctattatcgttttcataaactacggctctccatagtatatcacgccttaatggagcagctacagttgatgtggggaccggcacaaatgtcaatggttctaatgatggaaaggagcgaacggtaactaaggcgtatttgggaggaatggctgcgtttggcagagggtttaacgtggattctgcatgtgcggtggcagtggtagcttggtagcgtatagattgtaaagtctattgcataaaatggttgtaatgttagtatacggattcatcttcagaaaatcgacaaccaaatggaaaaagagcgagggacgatcctctgatacgtactttcaccaaatttctttttatcgtcattattattatttcaccctagttgaacgaaagattattcgcattggcgtcctttgaatgtatctcccccattattaatggaacctctgtattatacttttctatttcgaactttttgagactcattcttggtatcccagggtgacccagtaaccttttttccggtttaacatccgtgcattacatccgtacattctattttttattttccaaaaaactgggagttctacttaattttttggccccgtttgggaatctgctttgccacaggaggcggcctgtccaggaggacaatagaccaatggcagagacgaggtttgttgggtacgtgcaacagcgcctgggctcagccggcttgctgtgggcaacggaatggtgcttcctaagccaatctttcatgctgtagctatcgtcgtgatcgcttttactggcatattagcgtaatatgtatgaaattaggtattaatcaagcattaatcgacttaattctaagaaaagtcaagatctcgagactagcaataacaaaatggtatgttaatatggactaaaggaggcttttaaggacacgtaatattgagtcgacatgcgcaataaagtcatacaataaataagttaaagaaaacatatgacgatattttcagacgatatggaactgcgataccgaaaaagtggtgtgattgaaatgatactcatgttttggctatagttgcagtggctttccaaaaaattgggagttaaaatgcctatagcagtatcaccggagattcagtctcttgtggatcttctttttgcatagttgaacaagggataatatggcgccatgaactgcctctacacattataatgtgtttttgatatcagtatactaacaagttgaattgcatttacaaactttttattttgtattgcttttcgtcattttaatagggtagagttagaaccaagaccgtcaagcgtgcttctaaggctttgattgaacgttactatccaaagttgactttggatttccaaaccaacaagagactttgtgatgaaatcgccactatccaatccaagagattgagaaacaagattgctggttacaccacccatttgatgaagagaatccaaaagggtccagttagaggtatctctttcaaattgcaagaagaagaaagagaaagaaaggaccaatacgtcccagaagtctctgctttggacttgtctcgttctaacggtgttttgaacgttgacaaccaaacttctgacttggttaaatctttgggtttgaagttgccattatctgttatcaacgtttctgcccaaagagacagacgttacagaaagagagtttaaaattaaattagaaagctatttaaaataatttactattcaaaatatttgccttttcttttttaatttttgtttattctttaatgtataattaaataaaaaaatattattatatttactaattaagagcgaagcgttttatgtagctccttggccatacatacattgcgcgcaatgtttatgctttgataccaaagggctatcatctttgacttggaattatttatattttttaacattgactctgtttcctttcttactcattatacttatccagaaaaaatagaaaaattagttacttattctataattacacttttatcatgaacgccaaacatttgggagactatgggatacaataaaggcggatcatttcctaagttaagcgccttggcccactgtcgcctccctgaatcatttttctcaatcgcatgtaacatttctaactgttccttagcgtctaatatcgcttcggtcccgatcaaatgcagaagatatcgtagtaggaccagtaggcagacgtcacacttttcaatattcaaaacggcttcttcatacgaagcttggctacattgctcggtaaaagcaaaacattttgatttaaccaaaccgataacttcgttgcaaaatgaaacgccatctgataaattttcgactagcgttaaaataacgacacattcctgtgtgtctttgagtatctcagaaagggtaccttcagctaataggggtataaaataagactcttgcgacagattttcagtcataaaaaactttttgaactgcaggatatcattaaaagaagccaacgtccgtgagatcccctggataacatcatctgcaactattctcggagtaatcaatctatgtccatctggaactcttagtaatagtttgaaacatgacccaatcagtttcctccgcaaagctaatgatttttgtgatttgtacaaaggactacatttaattgtgggaatatacgtatcaacaattgtgttttcaccattatatacgggatgaaccggcgttgcataattgtcggatggcagtttgtaatcacaattgagaaatacatattcggaaaacctattcgcaaaattccttgtatttaaagattcaaaaaaaactgctaacggactctcagataagcgttgaacgaacaaggatttgcttacattttgggcgacttcatgctgtatgaaataatcttgtctacaactaaacagatcaatgagtatttcaagtaagggcatccaaatctcatggcttgataggaacagaggtgtgctttcttgcagcgagttagacaatgtccataaaatcatgttaataaattctccaggttcattcagtttcaaattcaataagcgattgcccaatatggtatttctttgctcaagacaactaatatacgacctgtaaggatttttaaaagttttagcctgatccaactcgggatctacactagcattttgcctatatgttacaccactttcagatttcgttctcctaaatctatcgaaaccccacttttgcttttttggtgtcaacgtatcgattgccaagaaaaactggcatcgcaacaactccaagtcatacaaattgtattgctcagaatcaaactctttcagaatcgccagatatttctgcaatagtttcaaagctctcctacttaaagtttccctggacgtgttatatggatcatttgccctcaatatcggctccttataatattcagataaagtcgataacgtgaaaagaactaatatgatatcgaacgggataacagccaaattgtgagatttgccgaactggcactccagaaacaacagcacatgatcataattttctaagagacacatggaattgagcatctcaaacgccaatagatgtttctcagtgagttcaacaaaataatgtgcaccattgcgtggactcacgtataaaacggaatttatcaacgcaccatccatactcagactaccactacaatcaccatttgccggcaattatcttcatatatctataattttattgccaacctactagtagtggtcttgaattagttttgaagggctctctatgtgggaaaaaatcgggccgcgcaatgaaaaatttttggcattataaattcacctcattgggaaggtaaaatgcatcttgcgtctgactcaatatccataaaatctattttcacgcattttgcctgcttcaaagaaatctatcgcaaatattcctactaatcatgtctatagcaagttatgcccaagagttgaagttggctttacatcaatatccaaacttccctagtgaaggcattctcttcgaagatttcttacccattttcaggaacccaggtcttttccagaagttgatcgatgctttcaaactgcatttagaagaagcttttccagaagttaaaattgattatatcgtcgggttggaatcccgtgggttcttgttcggaccaactttagctttggccctaggtgttggtttcgttccagtcaggaaggcaggtaagctacctggcgaatgttttaaggctacgtacgaaaaggagtacggttctgatctttttgagatacagaaaaacgctattccagcaggttccaacgttatcattgttgatgacattattgccactggtggttctgctgctgcagccggcgaattagttgaacaactcgaagccaaccttttggaatataactttgttatggagttggatttcttgaaaggcaggagtaagttgaatgctccagtgttcactttactgaacgctcaaaaggaagcgttgaaaaaatgatatgtttcacgtcctgacccatattcaagcttcctttctgccggtttcaagcaatttatttttcttacttctccttactctctcaatttggttgtataatatttactttttagattgaaaaatattcaatccacttttctgctttgtgccacaaagtagtctatttagttttttatctattatatgcttttaaagagtttggaaatcgagacctgcatatgcaatagtaatattcaagggtcctttgattctgactctaagcgagcatttgcctcctgaacttctcttaatgacgttccaggaacaacactccagtctatcattttctctccgcgggtattgtatagccaatcgtttatcattttgaaatggttggtaccaaaaaatcctctacttgcacttaatggagacggatgcactgacttcatcaccatgatattagggtacttactaccgcttccaacggaagtagatcccaacagagactctactaatttgatagcattgttcccccataagaggaatactaaactcttaccgtcggcctctctgtcctggatcaacaactgaactaccctttttgtaaaagtttcccaaccatgcttagaatgcgagtttgcattatgtgctcttacagttaacgaggtattaagcaataaaaccccttgtgaagcccagtgagttaaatctcccactttattatcttcaacaaaatcaggatactcttgcttcagttccttatatatgttctttaatgacggtggtgctggtgtagggggtttgacgctaaaagccaagccatgcgcctgattaaagttgtggtagggatcttgaccgataatcacgactttaactttattaaaaggcgttagcctggtccatgagtaaatatcctttgcaggcggaaatactgtatgatcagcttgctctttagtgacaaactgtttcaactttacaaaatatggctttttaaattcatccattaaatgtggaaaccacgaatcatcaatcgtttctagctccagcgacagtagtgtacgtaaattgctgctcaagttcttcgaatatacatcttttgcatttgaattagcaggatatttgtccgtgtttgcctcctttgcgaccgcctttgtctctgtcttgatagctgcgccatttgttatggtcatgaaagtagcgcccgatttacctttcttattgggcgcctcattagtgcttttctttgtaccaaagaagtcttcgatcgtagtttgctttctctttcgagccaccgtcataactgaatttgttggcaatcttctcatgcaccacatgtatgtgaacggcttgtgtacagcttctgataatatatatcattatggatgaattacgcgttgcggacacattccaggttttgacaatagggaaaatattgagtttatatgtaaagctttttacaagtcactaatgtgaacaacgtgaggtaattccatggaaagttcatataagaatagttcgaaaactatcttttttattcccaccagtcactagattcggctttatacatatagtgggcttatcactgctcttggatagcacttttgcactacaaatagacaccattacgaagaattggaagagacttatatacagagtaccagtaggtagaatggtcacgactccattgcattcctcgccgaaaagcagtctgaaatcttcaacgacctcactgcgctcagtacatactcagtctggtcgtatggggcctagtgagcctaagcacagaacaaccaaatcctggtctatatggggaggtaatgacgaggaagaaccggagttatctaataaaaataaaggaaaggaaaccgcccaagacaacagtcaagaaaatgacaatgtttcaaatgagggaacacgcttgcacgataatcaacaaacaacgattttaaaggaaaccaccaggatcgagaagggtgagaaggacaaaaaagacagaaatgcagctatagtagaaaaaaacacaagaccacgagcatggccattcttttggggccgtaacaaaaaagatccggagccgacgcataacattcccactgatgcggataataacactttatcacgtttagcaaatagtctaaatccggctcctctaaccaacacttacataccttataaacctgatgctatattgatcagagataaaggtgtcaaaactgctaagaaattaacagatgacataggcaatcagtttcctaacattgttgtaccaagtttcgatattttaccgaaacaaaccatatggaatacagtcacatccacaatttggaagtggaagactgaatactgggatagaagaccttcatcaagggtacgagagggggaagaacaggtgcagcactcacaaaatcagttaaaagaggaaacaaacacagttgcaaacgaggcaaaagatgaggagcggttggaacacaacagaggatctctatttagggttgatccatggaaaaaaataaaccttctatcagattaccaatctaggcccatcagagttctcattgtcggcgttcatgggttctttccaacaaaaattattagaccgtttattggtgagccaacgggtacatctaccaagtttgtcacagaagctgaggaaatagtgaaggaatattttgatcaacataaagtacccattgaaataagcaagatcgctcttgaaagagaaggagagatatttgatagagtagatttcttctacgaagttatgaagcattggagcaaagaaataaacaattctgattttatttattttgttagccattcgcaggggtgtccggtaaccattatgcttttagcgaagctgatcaaaaacggcataataaaccttgataattctcaatttttcaacgatgaaattcagttttgttcgtccaaaaaaattatctcggtcttggccatggcaggtatcaataatggtccattctacggtgcagatcaaactttgtttgttcgtgcttaccagacgattgaaaaagactcattgagggagttattcgagtttcaaaagtttgattccaaacaatcgcaaagcttcatagaaggcctaagaacaatcatatcaaataacgttaagattacatttgtgggatccatcaatgatcaactggtccctctgtattcatccacatgtctttttgccaaccatcccaatatatttcgggccatttttattgatagaggatcacaaactccagcatttatcactcgcatagttaaaattgctggttcactcttaaacctgggttataacgatcacggaatcataaaggaaataagcggatctctggcgggcaccctgacaggaggtggtcactctaccatttataatgagaaacaggtctaccatctgggcatcaaatttgcattagaaacaaccgatttgtccgaaatgtatccaattgagtactcaccatataaattgtctgagttaggagccaacccctatcgtctgccatggtgtatgaggggattgatgtacgagtccaacaagcatttcagtaatgaagaaatcaagatgttgtttaaggaatttgaggaatgggagcctgagacaaagcaattgaaggacataaaaaacaggcttaatggtttgaaatatcgactctgataaaaaatacatccagcatgataccagcttgcttccgcaaacgaaacataacttaaggtaccgcaattcaaaaaggcattcatacgtacaaatattaactatatctgacattatttagactatcacaagcagtatttatttatttatttacttatttattcatttattcatttcctttttagtcttttatgccagtgagctactgtcgcgaattgaaaactgcaaaaaaataaaataggaacttggattcagaagttttgataataaaattgcatgtagatgagagccgcgaactgaatcatacaaaaaaaatatgaagtggtgtagcacatacattattatatggctcgccattatattccataagtttcagaagtccacagccactgcatcccataatatagatgatattctacagttgaaagatgacaccggtgtgataacagtgaccgctgacaactacccactgttaagccgtggtgtcccaggttacttcaatatcttgtacatcacaatgaggggtacaaacagtaacggcatgagttgccaactatgccatgattttgaaaaaacctatcacgcagtggccgatgtaattcgctcgcaggccccacaatcactaaatttgttttttacagtggatgtcaacgaagtaccacaattggtcaaggatttaaagttgcaaaacgtacctcatcttgtggtatatccgccagcagaaagtaacaagcaatctcagttcgaatggaaaacatcacctttttatcagtactctttggtacctgaaaatgcggaaaacactttacaatttggcgattttctggctaaaatactcaatatttcgataacggttcctcaagccttcaacgttcaggaatttgtttattattttgttgcgtgtatggtagttttcatctttattaagaaagtaattctaccgaaggtaactaataaatggaagcttttctccatgatattgtcattaggcatacttctaccaagtattactggttacaagtttgtggaaatgaatgctatccctttcattgcacgtgatgctaagaatcgtataatgtattttagcggtggttcaggatggcagttcggtatagagattttttctgtatcattgatgtacattgtgatgtccgcactgtctgtgcttttaatttatgtgcccaaaatctcgtgtgtaagtgaaaaaatgagaggactattgtcgtcatttttggcatgtgttctattctacttcttttcttatttcattagttgttatttgataaagaatccagggtacccaattgttttttaattttgagaaaatgcgtttttcagtttcattataacatgtatatttgcatttctttctcacggcaaagttagtgacaaagaataaggtttgtatgaagccaacgagatactttttctcttattgaaaattcttttggcctctgttttgttagtctggatactgaaaaaaatgtttaagattattaaatcacacaggaatgaaattgttattagaaaaattataatatacattctatatagggaaaaatttcttctgactttgaaatttagatgctaatagttttttttattatttctatttttttttttttaagatcagttgtttgctgctggcacctccactgattcgtaattgctagccgttattgagttctcaaaatgttcctcctcagagcttttgttaatgatgaaaaatgagcctaagatgagggtagcaccaaataaatagagcgcagacatggttttgtgcttaaagattacatcaccaaacattgctaggggtatcgttatgctcaatcctacggtgacggttaaaggactcgttagtaacatagcctttgcccaacaaaagtcgctaacaaatgtgatgagacaattgacgaagattattaccacaactttaggatctttgggcagagagaatggttcccagccaaaaaagtccaatacaatcagtgatggccatagaaaaagtaaattaaagagaccaacaaagccaaaaaaaatcttcatgttaacacgagtctcatctccgacttctctcttcaataaagtactgtagacaccgtaaagtacagcacctgcaagtgccaacaagttgcctatcagaacttgcacggcatcgttatcatcaccactaacgtccgcgatatggcgttggtagcgctgatgagaatctgatttggtgaccatgattatgcctacaaaggaaatgaacgacccgagtactttggacttgctcaacgattcaacatgacaaatagcacctatgaacaaggtgaaaaaggaagaagtagtggagaggattgtctgcgatgccaccgatgtgaatgccagcgaggcattggtcacaaggttagctgtgaaccaaagtatgcagaactcagcacttaacttgattgtttcatataacgttagcctcttcttttggttggcatgcgtgcctgcttcaaggtttgtaagcagtgggctagtcatatcaaccgagcgattgctatcactaccagtaccttcttcctccataattagttcgcggtgaacgtttgcacggcctgtgtccttgtaattcaccacaacggcctttgcagttggaaaaagataaaagataaaggcggcagtattggtgtacgtgataaagaatggttttctatacgagtcatcctcgaagatcaaatttatcaggaaggacgataaaacccacaaaataatgactagacccaacatcagaagacccaaggtccacctcttattaaaggacgtttgatccttcgacaccatggctctgttgaacttttatctgagagaggaaaaaaaggaaggaaaaaaaagaagaaacttcctttatttatttgtcttaaccacaacacacaatgcaataagatgcaatataatatcaaagccaatatcttatgttgctgatcctgagaaggaatatatacaatttatgtagtaaaataccttttcttctgcgagttgcaagaaatagaaaagactccgattgcgcatcgccagaataaaatttcacaaccacactttttggctgaactttttattacctgattaaacagagagagaaaaggtagaggtcaaaattttttaagcaaaactaaaaaagatgcaaaatcacgtgctgaaaatctaacataagggttaagattagagttttataggacttgttttgtaatatttcaaatacgagctaaccctactgatttcaattaggtctaatttagggttgagctgcactgaaatttcggaaattttgggttattttaaatgagacagaagaactacagagatacgttcttcagactttaaagcttatctccacaaagaattggtcaagaaatcatcctagaaaaacacgtttgctcactcgatcttaatcacatagagtgctggaacgggaagaaatgggtatgtgcctcggtttttctcattaaccccttttgatccataacggtcctcttttgtttccttttttttttttgttttagtattttatgtttactattttcttctgtttcagtcatacgtaggaattattgcatgaaagaggatataatattcatgtggatttttaagaaaatagatcaagtttaaatagccactaacaattgaacaatgctctctcttggcctcttttcttcttttttatcgtttctctaaaaatcaagctgattagacatggtcttgcaatgtttttgctttctctaatcagcttggttttccgcaaagaagagaaagtcacggaattgtctacatatgtttctattcaggaacaaataatacatctaataataatggcactacgaagaaaatgtccctagaagaatttctagggaacgacactttaggcgagtcagtatgggatgaggaagatattaatttggatgctataagcaatactacgaatattgacatcttgaaacaaaccaaggcaggcgaacatcaacgtgatggtcaccaacagcacccacacggtggtcatggacccatgaacagatcacgtttttctaatgcagggccttttggtggtggtagcatgggggactttgcaaatcatcaccacccgctgcagcatcagcaaggtcctccttatattgtgaagttttctgatttaccaccgagattttccaactttgacattgaagatctttttcaagcaaagtttaccaagtttattaagttcaaactgttttgggagataaataaaaatccaagtatttctactttgaaatcggggtcaatctttgatcaaaatttcaaacgtgactcgaaggtagcatttgtcgagttatatacatcccgtgatatggacaaaattttgaactattggaccactcctttgaaggaaatttaccacattacaacagcgcccgcagaattcgaagattttaaggattacagcacgaaggtgaaattattaacagaccctaaagacgatgctggcaaaccattcattactaagactcagcggtcaaaatccaatccttttggaagtgctaaaccggttgatacgcaatcgaagattttggacattgaagaaaaaatggaaaatttacacgtggaagatacaacaaccctgagggcatcattaatccctagtagtgattctatggcaaccactgcaacaggcagcaagatcacaatcttgaaaaagcagacacctacagaggaggaatcacattctgcaaccccaactcccaaacctttaagttactctgaagtagttgagagatctgtggtcaatgaaacttccaagaaaggaactccattaagcaagcttgactcaccagctcttgaactacaatctaagcccgataaatcggacgagttcaaaggtggcgatgaacaaggctttgagaaaggtggcgacgataaagctcaattagatgtctcaaatgataaagataaaggttcagaaaccgatgttgataaacagttcactttcaagaatgtggaaagggaacatagtatgagcagaaccaaatataacggaaaccataataacaataatggcaattttagagggagtaatagatatcgtggaggccccaatggcagcagttataaaggtgggcataacaatcgtggtaatcgcggcggatatcgtggtggcagctcatacaacaacaacaacaacaacactaatgataataataataataataataatagtagtagtaataataataacggttcaagatatcatgatcgacaaaacaatgaagaagggttaacctcggattcatctttagatgcctcaggaaataaaaagaatgatttcacgaactcaacatccaatacacaacaatattccattttcaaaccagcaagtgggttccttggccaaggtaataatgattctataaggaacaatggacgcggtaactataacagcagcggtatgaatggaggttcgagaggaagaggatttggcagaggaaggggatttggcagaggcgcatataacaatcgaggtagtcgtggtggacgtggaagcagcggtaactactccaactacaataacagaacaacagacatgcctttatgagtcatgtactgacccattaattttcttttctctnnnnnnnnnntttcttttttttttttttttttttccttctatttcctttttttgttctagtcggttacgcagttctgagtaatgtaatatagcgttccttttcctctcagatttttttgaccttattttgtttccactttttactacttatgctgctttttgtccatttccccttcagttgttttgaattttttttttaaaaaaaattcgtctttctgattaatcaattttgattatatattttctcttgattagttcacaatttttataggcccttatttcttaaagaagttttatgaagtttcgtaagtattgggggggttgaaaataatctctcacgttatacgcaataaaaaattaaaattaaggagaaccaatctatagaaacgaaccattgaatttagctatatgactatataccattacgtaatttatataaacagcttaatatagcgaaagcaaagtagaacgaaatttcggagagttctagattgtatagagcgaatgagcattcaatacacacgcgaaggcagtaggcgatgaaaggaagttttttaatgtcattaagaaaaagatagggaacttctatttcctgtctttcatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatatatatatatatatatatatatatatatatgtgcatatgtacatcgttgagttgttcatgaaataatgaatataatacttctggattttttagtcagtaaatttactgttgagattcgttatcatttgtgatgcttgtttccatcatttgctgttgttgattagccagttttctttcctgtctacctttcttcataacttgcttcaaagctgcactatctagtggatctaacaattcaaaagagcacaataaaccttcgctgacgctcattacagccccccaattatcaaattcaccacaataatttggcgcggaaaacaccgtaacgagacttctatcattgaaaaattcataaccgtcttccacaaccatgtgagctctacaaaccaaatcaaacccaaacttgttcaagaatttgttaattgccaccttattataacagtaacttacaccacgttcgttatcctcccattcgttgggtgaatctgtgggatcggaccacaaaagatcattaattaagccaaaatctggtacatcagtaggcctaactacatgtctgatttcatccatagaatttaaaactggcgacaatccaccatgaacacaaaaaatctttccggctacgatagcagctaatggtaatgtattaaaagtatcgatgaatgtcttccagatcttgatgttacaacgacgtttacattcatcataaaatccataaacccttgtgacgttagcacattcatggttgcctctcaataaaaagaaattttcagggtattttattttgtaacaaaacaatagtaaaatagtctccagtgactgtttaccacggtccacataatcacctaggaataaatagttcgaggatggtgggaacccacatttggtaaaaagccttaagagatccccatattggccatgaacgtcgcctacaatttttacaggaggtgataattctaataaggaaggttgagaaagaaagatttcacgagccttgatgcaaatctgtaaaatttcattgttcttcaaacaaacattttttgttctcttagcagcgtagcccgcatccagtaatttttggatagtttcatcaatatcgataggctttttgaatttttttggagcgtttttgtttccggaagattgcattatatcattaaattcctcattcggatcttttttgctatctgttatattattatttttatcattaacattttccattgatgcatggatattactcaattgagatgaattttcaatgtcatcatcattgctgatgtgtttgctcgggtaaatatcgcgacttgaatggtgattcaatgaggaggttgaattagaggtaaagtattcaccagagtgatctgttagcttggacaagcctggagagtttaatggggtgctgtatgcggtattaccatctgatccaaacgaagatttcctactgtgtagcgaagatgcatgagaatttgaccgggttaatgcctgaacgagataattctcctgattgttagaggagtatgatccattgttaggctcttcatgggtcacatctgatttccttcttgacactgatccgcttcttatactggacggacgagaattcgaagatctagaaaaccttttagtgtgcgagatgtcgttgtctttatcatcattgtcatcatcggttaaggcgttctcataataggtagatgagtatgaagatttatgcttggatacgtgtgtgctactattgtttgtttttaaaatgggtgacttgggttccatttggatcattgaaggtggtaaatcagcagcagccttagtattataacttgatcttctagaagtagaaggcctcttagtagaggatgatgaaggagtagttaacaattcgttttgagaatttgaatgcgagtgtgagctagatgggaaatggtaacgattcgtgtgagagctatgtcgttggtgattaacctcaagattgggctttgatggagtggagggatcagggacgtttgaattagtattcgtagtggacgaagaaggaagagatcgccttgatcttgaagatttatttgattttgcagacttcacagaatgggaagtctcggttctcgacacttgaggacgaggatttctcgaggaggaattcgaatgtgaatcctttttcgaagattttgaacttgaattacccattttgaaaaggaaggaaagataagcagagagtggttgatttgttgttttatgacaaagcctctaggggaaaagaagcgactataacgatgaaataaaaataaaacgataaagaaaagtataatcaaatgtattccaaagaagtacttttatatataatctttatatttaacttgaaagaaaaagatttaacatgtattgccaaaacaaacaaaactaataatggaagctattgtattgtgcttttatgttacccacctgccaatggttcacaagagaaagctgattaacagaattagaagatctgcagtaatcgttttctttttttttttccattaatttatatgctatccttttaaaaatagacatgtcatttcaaacgacatgttaaaaattatatatatgtttatatatagattgatatatgttggagccgttggacaattatgggcagctatctgaacatggatccctgcccttctccttgagttctccagtaagcgttaggcaaagtgtccgactgcagacggtagagtctccacgcctcacggatgtgttcgggcaataagggactgttgttatatttctcgatgcttacatctagtttgttgaattggaggacgagcttattgtactgctcgatgagttgtagcttcaagtcctgtgaattatggtctgattgctgtaaggatttggactgtagcaacgagttgcccagcgtagtttcgcgcttgtctacttcttcatcgtcgaagtagaaatcaggttcgtcttcgggaacgctatcggattgataatcttgcttgtattgctggttttctatgatggagaaagtcaatttttttagatattttttcaatttatagcctattttggtcctcttatcaaactctatgcacatttgacttgtcaaccacttattcttcacaatcatggccaattcgattatctcaccagcgtatatttttcccaccgcttgcagaaaaacacgaatattttcacttatagtttgattagctactgtgctagccagttttttgacctgggttttgtttagggatgttctatggaaaacttcaaaccgattagtttgatctttatccaagttggttaccaagagcttgaattgttcgtcctgcgcaagtttttcattttcatcttcgttggtattggtgtcttcgtaattgctattttgtgtttgctgttgtaaaatgtcttgtggaaagatcaggttttctgggactttgttgatagagtccgggtcttgctgatttatcctggttttctggtatttgtattttggatatttatttaattggttgttgattgatgtaccacccgttcgcaggttttgcaatttccacgtaacgtagtcctggtcctcactgatgacttggtcaatcatttgttttgtggaaaaatagtttgctattgtcagtattggcggatagttcactttcgggatggtgtccaaaggaccttgaggttcggtcatcgttgcgctgttgaagctcaaacttactttgtgctcttcatttatatggataattatctctatatacctcttcttgatttttcaatttctttcaacttttcagtcgaagaaatgggaataagagaaaaaattcggtaatgaactgaacagagatgaggtctcgaagagccaagaaataaaaggttaagaaccaacatggagataaaccaagcggctgaaaaagaacaggagtatgttcacaaagtgtataatgagatagctccgcatttctcgcaaactagatataagccatggcccatagtgactcagttcttgaagactcgcccaatgggttccatcggtatcgacgtcgggtgtggcaatggaaagtacctcggagtgaaccctgatatatatattatcggttcagatcgctcagatggtcttattgagtgcgccagaggaataaacccatcgtacaacttactggtggcagacgggctgaacttaccacacaaaaacgaaacatttgacttcgccatctcaattgctgtagtgcatcactggtctacaagggagagacgtgttgaggtgatcaggcacgttctatcgaagctacgtcagggcggacaagcattaatatattgttgggctctagaacagggcagctcccgtagaggttaccatgaaggtatggagcaagatgtctttgtcccctgggttcttcccaagagtaaatccaaaccaaaaactaaatcaacgccgcctgctaaagtcaagacaaggccaaagccaaacttaatgaatattcccccaaaggagcgttccgaatacttgcagcgctggaaggaggaacagcaacgcagtaagtctcttgatgataacgacgagaagcaacaacaagatcaagaacaggaaagagaagaggtaaaataccgatactatcacttataccgagagggcgaattggctgaggattgccgccaagctggggctgccgttcatagtgagggcttcgagcgcgacaattggtgggtggtggcccagaagagatgaaggtgatatataggtagacagtgtattttgtagcagcaggtattacgatagaagtatgtaatagctttcatagtgtaatcgaagatgccagtagtcaatcatgaggatagtgaatttcacctttcgcacacagaagaggacaagttaaatgagttccaggtcatcacgaatttccccccagaagacttgccagatgtggtgagactgttgaggaaccatggttggcagttagaaccagcattgagccgatatttcgatggagagtggaaaggcgaaccagaccagatgggagagcccactcaaacgtctacacccatggctgagaccttggttcctcccgcgttgggacctagaccgttgttatttacagcctcactgcccgtggtcagaccattgccagcgaacttccgcaatgatttcagaacaattgggctaaatggacgctctaacactgtgtggtccatgtttgaatcttttagttatgatggtaacccctttctttttattttactgttgatccctcggataatcaataggttatctgccacaatattcacgttcttttgcactctattgtccctgcattcgataagtggtggcggtaattcaggaaaacccaagatctccaaggttccaaaggcaccaaccagagaaacccatatcccacttgcagaaatactgggtgacacgaaggacaaggatgcattttgcgaactaaaaagctttaaaccagacatttccttcaatgaggccttgcgtattgcaaaagaagagtttaagtttatgttgctcatcctagtgggcgacacctacgataccgatactgataccgtagatgttaattctaaactactattggaaaagattttgttaaacaagaagactttacagtacttgcgcaagattgataacgacctgattatctatttgaaatgcgtacacgagttggaaccttggctggttgctcgccaactaggtgtcagaaacaccccggagatattcctcattgccaacgtggctaataaggcttcccattcagaaactttgccctcacaaagactctccattctcggcaagctaaaggtcaattcactgaacagattcttgcagtcgttaacaaacgtggtggaaaagtacactccagaattagttgttaataaaactgaaatgcacgagctacgcatgtcaagagaaataaaaaaactgcaggaggatgcgtacaaaaagtcgctagaaatggacagaatcaaagctatagaaaaggaaaagagcttgaaacacgctcaggatttgaaattaaactcaactgctcggcaattaaaatggttaaaggcttgcatcgatgagatacagccgttcgagacaacggggaagcaagctactctgcaatttaggacttctagtggcaaaagattcgtcaagaagttcccctccatgactacactttaccaaatctaccaatccattgggtgtcacatatacctcgcggtatattctagtgaccccgcagaatggtctaacgccctccaggacaaaatcaggcaattatctgcagacgacgatatgctctgctttaaagaaggacaactcgaaactgctactgctaccactatcgaagagctcggccacatcatcaacaacgagcttacctcatttgatctcgaacgtggtaaacttgaattcgactttgaattggtatcgcccttccctaagtatactgtgcatcctaacgagcacatgtcggtggaccaagtgccccagctatggccaaatggcagtcttctagtggaagcactggatgaagaagatgaagaagatgaggaaaatgaagaacaatgataaaatagcatatcgttaaaaacgacaaacgcgtacaaagagtttctggagtttacttttttttcatttttcgtttttactctttcgtctccctaatgattttggccaaccgttggttgttacgtgttatatgtttgttttaggagctggggcctacctttatagttagttgtataactcagttgatctcataagtgaaaagcaaaaaaaggatgcaggtgttacagttatggttgacaactttgatctctttggtggtggcagtgcagggattacatttcgacattgcagcatctacagatccagaacaggtttgtattcgtgattttgtcactgaaggtcaattggttgtcgcggatattcactcagatggttctgttggtgatggacagaaactaaacctcttcgtgcgtgattcagttggaaacgagtatcgtagaaagagggactttgcaggcgacgttcgtgttgcgtttactgctccatcctccacggcattcgacgtttgttttgaaaatcaggctcagtatcgtggccgttctttaagcagggccattgaattggacattgagagtggtgctgaagctcgtgactggaacaagatcagtgccaacgaaaaattgaaacctatagaagtggagttgcgtagagtggaggaaattaccgacgaaattgtcgacgaattgacttacttgaaaaacagagaggagagattaagagacaccaatgaatctaccaacagaagggtaagaaatttctcaattttggttattattgtcttgtcctcgctgggtgtttggcaagtcaactatttgaagaactacttcaaaacgaaacatatcatttaagcaaaggaagaggaccacaccatgcatttgtgtatcagcttaccctataattgcatatgtactcgactattttctacatatatatgaatagattccagaaccgaataaaggagaaaaaatatttgaatatggatttgttcgcttcacatctttaagtaacctagttttcccaatacgcaaccaaagtccaagtatgtcatgaaaagcctcttgccatcagtagcacaactaatcatttcaatggtcccagaactttggtcagccccgatgagattggagattttttgaaggtcttttacgcttaatacatgatctcttaaggccacttgcgggaaatccacgtctctgccacagtttctaataagcatcgaccataaatcatctattactgttaaattattcatcagtatcagtaactggcatgtgcatcgtaccagtttcgtgaaatctattacgtcagttccttctataatgacgtcttcatttctcaccagtttccaaattgtgggctctagttgcaaatccttgaagaaccttggtagttcattaacggtcatatcatggtccagactggattccgcatatttttccagaatttcatcttcaacttcgataggtactttcgggttctcgaatagctctactctttcataactaacgttagtggatttgctcattgaaaaaaaactcggaaggtatttaggtgaccttgcggcttcttaatgctgacacctgcatgcgtaattgttattatatatatatatgatagtatatttcatacttgttccttctaaaggtgacccgcctgatatgcgacatagaaaaaaatttggatgaacatgttcaaagattggtagcattgacaagaaccattcatacaagtaggtaacagcagaaggaaagaggaacgggtgttgtgataattatgagtgacaactcggacacaaacgtgagcatgcaggaccatgatcaacaatttgctgatcccgtagtggttccgcagtcaactgacactaaagatgaaaatactagtgacaaagatactgttgatagtggcaatgtgaccacaacggaaagtacagaacgtgcagaaagtacaagcaatattccccctttagatggggaagaaaaagaagcaaaatctgagccacagcaacctgaggataatgcagaaacggcggccacagagcaggtttcatctagtaacgggcctgctacagatgatgcccaagcaactttgaatacggattcatccgaagcaaatgaaattgtcaagaaggaagagggctctgatgaaaggaagagacctcgcgaagaggacaccaaaaacagtgatggtgataccaaagatgagggcgataacaaagatgaagacgatgatgaagacgacgatgacgatgatgatgatgaggacgatgacgatgaagccccaactaaaaggcgtcgtcaggagaggaacagattcttggatattgaagctgaggttagtgatgatgaagatgaagatgaagatgaagaggattcagagttggttcgtgaaggtttcattacccatggtgatgatgaagatgacgaagcaagtgctccaggcgcaagaagagacgatagattacatagacaactggaccaagatttgaacaagacttcagaagaagacgctcaaaggttagcgaaagaattaagggagcgttacggtagaagcagctccaagcaataccgtgctgctgctcaagatggttacgtgccccagaggtttctcctaccaagtgttgatacagctaccatttggggtgtgcgctgcagaccaggtaaagaaaaggaattgattcgtaagttattaaaaaaaaaattcaatttggatagggcgatgggtaagaaaaaactgaaaattttatccattttccaaagggataattacacaggaagaatctatatcgaagcccctaagcaatccgttattgaaaaattttgtaatggtgttccagatatttatatttctcaaaaattgctaattcctgtccaagaattacctctattactaaaaccaaacaaatctgatgatgttgctttggaagaaggtagctacgttcgtattaagagagggatctataagggtgacttagctatggtcgaccaaattagtgagaataatttagaagttatgctgaaaattgttcctcgtctggattatggtaaattcgacgaaattgatccaacaacacagcaacgtaaatccagaagaccaacttttgctcatagagcaccaccgcaattatttaatccaacaatggctctaagattagaccaagctaacctgtacaaaagggatgatcgccactttacttataagaatgaagattatatcgatggttatctgtataagtccttcagaattcaacatgtggaaaccaaaaatattcagccaactgtggaggaattggcaagattcggttccaaagagggcgcggtagatctaacatcagtttcacaatcaatcaagaaggctcaagctgcaaaggtcactttccagccaggtgatcgtatcgaagttctaaatggtgaacaacgtggttccaagggtattgtaacaagaaccacgaaagatattgctactatcaaactaaatggctttacaacgcctctagaatttcctatctctactctgaggaaaattttcgaacctggtgatcacgttactgtcatcaatggtgaacatcaaggtgatgctggtttagttcttatggtagagcaaggtcaagtgacatttatgtcaactcaaacaagcagagaagttaccattacagcaaataatctgtccaaatccatcgacactacagctacatcaagtgaatatgcgctacatgacatagtcgaattgagtgctaaaaatgttgcttgtattattcaagctggccacgatatcttcaaggttattgatgaaactggtaaagtgtcgacaattacgaaggggtctatcttgagtaaaataaatactgctcgtgcacgcgtttctagtgtcgatgcaaatggtaatgaaatcaaaattggtgataccatagtagagaaagtaggttcacgcagagaaggtcaggtcctgtacatacaaacacaacaaatttttgttgtttcaaagaagattgttgaaaatgcaggggtttttgttgttaaccctagtaacgttgaggccgtggcatccaaggacaatatgttaagtaacaaaatggatctaagtaaaatgaatccagaaatcatttctaaaatgggacctccatcatctaagacattccaacaacccatccagtccagaggaggtcgtgaagttgcactcggcaaaacagtaagaattcgttctgctggttacaagggtcaattaggtattgtgaaagatgtgaatggtgataaagctactgtcgaattacactcgaagaacaaacacattacaattgacaagcataagttaacatattacaaccgtgagggaggtgaaggtatcacgtatgatgaattggttaatagacgtggtagagttccacaggccagaatgggcccaagttacgtcagtgccccaagaaacatggccactggcggtattgcagcaggtgctgcggctacctcttctggtcttagcggtggtatgacaccaggatggagctccttcgatggtggcaaaacaccagctgtaaatgcgcatggaggctcaggtggtggcggtgtctcctcatggggtggtgcttccacttggggtggccaaggtaatggaggtgcatccgcttggggcggtgctggcggcggtgcctcagcttggggcggccaaggtactggtgctacttctacttggggtggtgcttcagcctggggtaacaaatcaagttggggcggtgcatccacttgggcgtcgggtggtgaatctaatggtgccatgtctacttggggtggtaccggtgataggtcagcctacggcggggcttccacctggggaggaaataacaataataaaagtacaagagatggcggagcttctgcatggggtaaccaagacgatggaaataggtctgcttggaacaaccaaggaaataagtcaaactatggtggtaacagtacatggggaggtcattaatcaccaaaaggagaaccaatatcacccaagaagaaatcaataaaaaagactttaatattaccacgttaataagaatagttatgaagatttcgatgtttcgatgaaatactgaatctcgatctttttttttcatttatgcttgcatttgtatgtcacgagttttccttgattctaacttttacatatacgtatgtatgtatgtatgcatatgtgtttttgcatatctaaatgaaatatcaactttattatgagggagttgattattgtaatgtaattttatataacttctttttcgttagcggaatttctttccgtttgaatcgtatacaaaatgtatgtatccattacttatttacaggataaatgaaaaaaaatgcgtaacgtctgcgtattcgatgggcttacatgccggggctcgtgcttattcatatttcttcacttggctgtacgcaagaaatccaatggctttctttctgccactttccttttctttgcttctttgaaaagcacatgccgtttcaccacaggatcgtatctgacctgagtaaccaaaggtgcacctttcttaatcgagatgtaacgagagtatccacttgccgctgtagacaatagctttataacactattcttagatttcacttttaccatatcggcacataaatatggaaacagttacgatgttgtattcttactatcttccgctgtaggggagcagtcaatacgtttgtatgcagtgaattatagttttttcttattctgatagaaaatactggtcgtttgccacgacatgatgaaaaaaaaaaaagccgaacttgaaaatcacaagtgggataaattgtggggtagtaaaggcatcggacagtctgtttgtaaggcctgctagcaatgaacgtgctatctttttatctgcatatataggaaaataggtatatatcgtgcgctttatttgaatcttattgatctagtgaatttattgagttgcttcttgggaagtttgggagggggtttcggcgttttctggcttcctagcgacgaaaagcatcattggagtgaataacttggacttaccaccggcaactaaaccaaccgcagcattttctagagcagcagtaacttccttggaaccttctggggctagacctaatttttccattacagtaaccattgctgtagtaaattgtctacccaagtaagaagttctgaaaaatgtggccaaattagctaagttttgaacgtacttccactcaccagttaatgggtaataccaagggatttcatcatcattgtccgccaggtcttcgctaacgaggacttcgaaaccacagttcttcaatgctttcctagccacgtcgacatggaacatctttgggataccatcacctagttcaatttcataagcgatctttctatgttcaggattgttttcgtcatatttatcagtcattacccattcgtaaacagcaaaggtaccacccggtttcaaaaccttgtagatttcgctgtatacaccttctaattttggagcgtgacatgtggcctcaattgcataaactttgtcgaaagtgttttcttcgaaatccattttcatgaaatcaccctttacaaagtccatttggtcactcaaattgtattttttagcgtaatattttgccttggcaatttggtaatcgttattgtttagaccgatgacgttacaaccggtaaatcttgcaatctctcttgctgggcccccaacaccacaaccaacgtcgagaactaaatcgcctctttgaataccagccttgtaagctaaataatgttcatgtcttgctatcgaggcagcgaaactctcacctttataaaatctgctgaaatggaaagaggaaccccaaccatattcatagaaatctgtaacgacgttatagtaggaatgtgtggcttcattataatcctcaagacgacgttcttcggcatctttatcggttctaccatcccaatttctcaagtacttctgaacggcttccttttgggcagagttgttcttcgacatcaatgcactcaaacctgtctttttaccaatatcatcaccatgtaactccctagtgaattgggcctgtctttttctcaattctgtttcactcatcttatgctgcctactatattattattttattcttgtttttttaaattatgtaaaacttaaatcgaaagtaaaacagataagggaaacttgaatgaaaattaacagcttataaattacaaagacgaatggaaagaaaaagagagcagcagaggataggagaaaacacccgaactatataaaaagcaatgaagaagttatcggcaacagcaagtattggaggtttctcaccaatcttcgcataaaacgcatgcttcgtaaggcgataaaaatgaagtgtaccattgagacgaagtggagcagtttacagtgaataatacattgtctgctcctcacttactctcgcttctcgaaaacttttttgtatttatcggaaacggcagtaaacgacgccaaaaattgaaaataagtacgggaacgaggtaccatatacgaagatcggggctttgttcggccctaaattttgctgatcttaccctgttgcatcttttcaaaaatagtaaccagccctagctgtttggttgatttgacctaggttactcttttctttttctgggtgcgggtaacaatttgggccccgccaaagcgccgtctttgtcatgggaaccggaaaccctccgatgaagagtaggagggtggcaactgatggatgcgtaaggtcttaagagatacatttgcttaatagtcttccgtttaccgattaagcacagtacctttacgttatatataggattggtgtttagctttttttcctgagcccctggttgacttgtgcatgaacacgagccatttttagtttgtttaagggaagttttttgccacccaaaacgtttaaagaaggaaaagttgtttcttaaaccatgagtgtgtctaccgccaagaggtcgctggatgtcgtttctccgggttcattagcggagtttgagggttcaaaatctcgtcacgatgaaatagaaaatgaacatagacgtactggtacacgtgatggcgaggatagcgagcaaccgaagaagaagggtagcaaaactagcaaaaagcaagatttggatcctgaaactaagcagaagaggactgcccaaaatcgggccgctcaaagagcttttagggaacgtaaggagaggaagatgaaggaattggagaagaaggtacaaagtttagagagtattcagcagcaaaatgaagtggaagctacttttttgagggaccagttaatcactctggtgaatgagttaaaaaaatatagaccagagacaagaaatgactcaaaagtgctggaatatttagcaaggcgagatcctaatttgcatttttcaaaaaataacgttaaccacagcaatagcgagccaattgacacacccaatgatgacatacaagaaaatgttaaacaaaagatgaatttcacgtttcaatatccgcttgataacgacaacgacaacgacaacagtaaaaatgtggggaaacaattaccttcaccaaatgatccaagtcattcggctcctatgcctataaatcagacacaaaagaaattaagtgacgctacagattcctccagcgctactttggattccctttcaaatagtaacgatgttcttaataacacaccaaactcctccacttcgatggattggttagataatgtaatatatactaacaggtttgtgtcaggtgatgatggcagcaatagtaaaactaagaatttagacagtaatatgttttctaatgactttaattttgaaaaccaatttgatgaacaagtttcggagttttgttcgaaaatgaaccaggtatgtggaacaaggcaatgtcccattcccaagaaacccatctcggctcttgataaagaagttttcgcgtcatcttctatactaagttcaaattctcctgctttaacaaatacttgggaatcacattctaatattacagataatactcctgctaatgtcattgctactgatgctactaaatatgaaaattccttctccggttttggccgacttggtttcgatatgagtgccaatcattacgtcgtgaatgataatagcactggtagcactgatagcactggtagcactggcaataagaacaaaaagaacaataataatagcgatgatgtactcccattcatatccgagtcaccgtttgatatgaaccaagttactaatttttttagtccgggatctaccggcatcggcaataatgctgcctctaacaccaatcccagcctactgcaaagcagcaaagaggatataccttttatcaacgcaaatctggctttcccagacgacaattcaactaatattcaattacaacctttctctgaatctcaatctcaaaataagtttgactacgacatgttttttagagattcatcgaaggaaggtaacaatttatttggagagtttttagaggatgacgatgatgacaaaaaagccgctaatatgtcagacgatgagtcaagtttaatcaagaaccagttaattaacgaagaaccagagcttccgaaacaatatctacaatcggtaccaggaaatgaaagcgaaatctcacaaaaaaatggcagtagtttacagaatgctgacaaaatcaataatggcaatgataacgataatgataatgatgtcgttccatctaaggaaggctctttactaaggtgttcggaaatttgggatagaataacaacacatccgaaatactcagatattgatgtcgatggtttatgttccgagctaatggcaaaggcaaaatgttcagaaagaggggttgtcatcaatgcagaagacgttcaattagctttgaataagcatatgaactaaagcgggaactttatggaaaactgggtaaccgaaagaactttttctataatgttacaattaaacttttttaacttaccttgcttcgccttttcgccgaaagtaggtagattgtatcacctcggtatttttttatgtacacaacctatactttaaatatatttagactatgtatgaattctctgtatcaccttcaatgtcaatatagaaactggtaagtgcaatagtaccaataatgattataattataatacaagtatatatatatatctatatatagtggtaaagtattctttacatgatggcacaacgctgagatttatccgtacctgcagaaccactgtttttatgattcttaaacctattcatctggaatttccaacgctttctatccttgttagtggcatgagtagggttatctatgccgcttaaagactttagtaatgtaggtaaaggcaaacttttggacctttccacggcactcatagcattgatggaactctttatctttttcaactcatttttggaattactttcattgttacccttggaattaggtttgtgagaattttttgtcttcaaagaatggctaaaattcgaggaagtcgtattagagttcgacagttgtgtcattggatgaggttcacttgataaaactgtactttcacctgttttagagttatccaactcgttactattacttttatcgatttttgtaacagaattatgtctattgaatgcccattccccgatactgtttacggttctaatagaacgatgtgctgtagtaacgttagattccattctagttggtatgtacatttgtgggcctgactgttctgataaagaagcatcgtcaccatcgtcttcatcgtcttcatcgtcaatatagtcgttgtaaccgttattatatgcagtcgggaaatattgttgcgggtcgttagttaatgataactcagaatctagaggttgctcttttgatattccttccctattatcataattgggatttttgaattcttcttcaacctgtttgccggagtttgtcacaataaccattgtgtaaaataaaatttttggaaatgatctcttgatatctagcaaatcttgaagtgttagaatttgtaaattattcattgaaaaattggaatcatacagcaaccaatcatcggtaacgcttgccattgtaggtttattgtttgactgtctaatcgcagtaaaaatttctttggtgtctggatcctgaattaatatagattgcaaaactagcctaaaataccctagagaatcacaaattgagattgacggtagaatggatagtactgagtaatcggaagaagaaagatcttcatcatcataaacctcttctccatcgtcctctcctgatccatacccttgggcgtcatagttatgatgaattaaattatcctcctcctctggggttgtcgaagtagttaaattgtctatagaactcgttatacttgacaattcagagacataggtggcattcgtgtgatcgatgttttcacgttttggattacctcggctgctactgcttaaactgtagtgggcactactactattactgctactactatagctagtgtagctgaccgaactttccatgctataacttgcttgatcgatactctcgtcacctagatcatgtgagactctgctataatgatcctcaacttcatcctgaccactttcatcctcgcgcctggcagtagttaaactcaggtcttgtccgggatatgtggatgatacgtcttcgccagcaaaactatctattgacattatctcggaatgtgacggtgtatagtcttcattagtgtatgatggaaaaattttgggtagtctattaggctttgaatctactgttcgcgaatgagaaaaatttaggactatagaacttgtggcatcctcttcatcaacttcgttttcattatcttgaggcgtatcattattattgctttgactattcacggatgtaacgtttatatcaactgtgtccggagatgtcaaagtcctcgtattcgtattagttcgggtagctgttgaagtctgggtatttatatttgaccactgatcatccgaaacgtttgattctagcttcccgtttgaagcttttgatgaagatattgtgggtggtggtattgaatttctattgttattgtttaaagccttggaatttttttgaacttgccaacttgtactcgcaaattctaaaaaggtagggtcttggaaattgttgaggttgtccgtcaataggtaatgattttcatgattgtagcagtgggagtgagttaattttgagatttgaatgtgttctaatttttccagatgaaagtaatctttgaggaagatttccaatatggagatatcttcatgaacattctctgggatggaaactaacaaaatcttcttgtttggcctggccgaaatattgttatcaccataaaaatgactattcagaaatctttttaacagagtgtattttaattgattgcctataagttcttcaaaatcgcctaatctgaggtttgttaagtaccacgaccacaaaccattgtcatcattgtcaaaatagtcgcccactctaacggatttttgcattatatttaagtaacagagtgctttttgatggtttttgttaaccgtctttcgagcagttgaaggatgagagtgagtgttaatgaggggttatttctgcaaaacttctgccgatatattctgcacttagttcccgctgttgttcagccttcacgttccttagctacacaagtcagttaaatctggtcctgccaaagtgaataagttgaagatatttatctagcttgcgatggaaaaaactacaataggaaaaaaactaattaaaaaaagaaaaaaaaagagaagaattcaatgtttagggatataaattcgatataaaggtttaaagtaaataaatttcgtgtattactatgcaagtaatgtttctgcctgcaccggcttcgtagctggtggagtgcgatagcgatgatactacctgaaaacacagaggaaggccgtcagccccgcgctaggaacgatgaggagaaaccagttggcgaatcgccacatgccatttacgtaaaagatgctgtgtaacctaacagaaataatcgatggtgtgaactaaagtcctaggatgcacataagcaagcgaaaaagtgaaaacaacatttccagagctaaaaaaatgcatttgccgatccgaaataatctcaaaacgaaaaaatgattatggacgtaaacaaaattaccgcatttcgctctcctattatcataacaagcatgagcgcaaaacttaaaaatccatcaagaggcaaaaaataacgacaactgcaggactcgaacctgcgcgggcaaagcccaaaagatttctaatctttcgccttaaccactcggccaagttgccatactaacttgattatttgtgtattctgttttcttgtgattccttctggttacataattacattgtctatattcatatttgattctaacagcaggtaatattggtctatcggctactcgttcaaaaaattaaaatcgttatcaattatattccatagtataggttgttaaaagatggaattaattaaagtagagtagtagaacagggatcacagtgttattagattttggagcaactgatgtgtgtgagtaatatataaggatgaatcgaatgaaagtattatgagaaaaggaatcatcgttgtgtaaagttgttcatttcgtatttctgggtactgtgaatgagatgaacttgctgataatcgttggcatactattatttggaacggtaatatttttgcgaatacaaagtatactgtagtttttccccgaggatttacgaacccacgagaagtgatcaatatttctacacagtagcattatgatctctctttattcgcttatgtgtcgccattcactaccctatcataattcggatccttgtgtttcagctcccattaagtttgacgaccgttcgtcatttatttatattcttacaccgtacacgataatatacttatgcgaactctagtcggtcgatggtgattaattttcatttcaatatttacttatatcggcgataagtcttaagcatggaatttatagtcattctgtcacccctccgaaacagaaatgaatttgtaaatgtattcactaagtttagccgttttagacatttgaatgtcgttcgtcatcagcgcggccaatattgtttacatgaagaaaatgttgttaatataggcactctatttggtttcattatgagaagtatcttgctgcttgatgtcttcgcactttttttttccagatttttcaggtgatgaggtggagctggaggattttacaatattactcaaataatttgtagacaacgttagcgtgaatgagtgacgaaaccatgcctgtagaatttttagttagtgataaaagactgttgaaaaccataaaagttaaactggaaaccaacggcctttttgttactcctatctattccgataatgataacaaagttataaaatcttctattgaggatctcaatcatccattggctgtcgaaattaacaatatagccggtgtgaaggcacgattccatgaaagtggtaacttggaacgtagtgaaggacatttgaaacaccaaagtaacagcattacggaatttacgaagagctttttaaaagatcatgggcttgctaatgacaagatatttttatctcatttattagatcatttacctctaaaatatacaatatatccactagttgtattgttcaataattctacagtgagatcgtttaatcacccaatctggcaaaaagcattccaactgaaactcttcgatccaaatgagtattatcgtgagctgctatgtttcctttcgcccggcaaaccaagtaaaggcacgagtcttcatcctaacaatcgactactgactcatctggccataaataaccctatcacagaggcagatgtattgcgaagaccgttcaatatccaaccgctttatggcaaattgattgatgacagtattttggatgataacgataatacgttatgggaaaatcccagtcaagaacaactaaactcaagcatatggtgtaaggtcatacaaaatggtgtaacacaaatctggtcacccgtttttaccatgtttagtagagggaatatcaaggagaagaaaagagttttgactactttcccagatatttgcaataatgatgtggtcgatttatacgcaggaataggttacttcacttttagctacttaacaaagggcgctaggacactttttgcatttgaactaaacccttggagtgtagaagggttaaagcgcggcttaaaggcaaacggattcaataaatctgggaactgccacgttttccaagaatcaaatgaaatgtgcgttcaaaggcttactgaattcttatctcagaatcccggatttcggttacgtattaggcatattaatttaggtctcctgccttcaagcaaacaagggtggccattggccatcaaattaatttacttacaaggagcttctttggaaaaagtgacaatgcatatacatgaaaatgtacacatagatgcaattgaggatggaagtttcgaaaagaatgtcattgtagaactcgacgctattaatgagtcaattgcattaattagaaaccgtggcatcaaacttcagtttgtgagatctaagcttgaacgcataaaaacttttgcaccagatatttggcatgtatgcgttgatgtcgacgttatagtaagtacttaaatacaaaatataaataataattagtgtatgaaaagtcaacaagaatggtcattattgtaaaaaaaaaatactaacctcctattcatttcaactttttaggcaatcaaaccatgaggaacgacttcaatggaataaccatcaggatccttcaaaaaggcaatattcttcattctgccttggttaaatttaggagaccattggatcttatcgccgtatttcacttcaatttctttacaaagggcgccagcgtcatcacaacttatgcagatgtgaccataaccctggggctctgagttaccgttatgatagtggaagtttggatcattctcagttccccaattatgagttaactccaacacactttcacatgaaaaaacgctgtcggtctttggaacgccataaccaagaaagtataacgtaaattttgcactttcgtgctcactagttcttaataatttcatgcccaacacattctggtagaattctaaagaccgggttgggtttttaatacgaatcatggtatgattgaacttgttacctactgagccctttgggtattcctgaccctctctagaatatgtgatcaactcaatccagtatccatcagggcctaaagcaaacgcaatgtccttctgtcttccttcagagagtctcttcttgaatttgacaccctgagattctagctcttcgcaggttttattgatatcggatacagaaaaacagatgtgcccaaatccacgatgaggttcctcattcccgttgttgatcttgtagtctgggtttttttcagtaccccaattgtgagttagttctaagacaccgtgtgcgctaaaaacatcaggctctccattcttatttttgggtatgtcgtcttttggaaagcttaaaaagtacaagctaaattttgcttcttcaaaatcctttctgcttaatagcttcataccgaagtgttcggtgtagaacttaacggtccttgctggatccttgactcttaaacatgtgtgattaagcagaagggttggatcattcgaggctttctcaatctgaattggatagcgtgtactatcagtggacattgttagtttgtagctggtggcgtatctggtctgaagtgtcaaaaaaaaggcatggaaatgttattccgattttttttctccctatttataaacgtcactaactagaaatacgggatatcaactactacgagagagggacattctagtatcaaagaaacttactatgacgcagtttaggatccctgtggtgactacgtatccaggtctactactccatcgtaaagccccttgtttattcagtgtccagatcatatgcgggatgtgtattttgtgctgagtggaaaaataagatcatatgctcaagaataaagggttaaagggtatggaaatttcagttctccctggctcaagaacattgtcagtattcctataactgaagctgagtggtactaatgcaccgagatgcaaagtccgaaccacccccacccccctctttacctattttttatattttgtgataaagggataactcgtcttgccttcactgcgcttcgattctactttagctaaactaagcgttactttgtttgagaatctctcagccgttaaatcaacgtacttgtatactaaacagtatattcacgtgataactttgccttacacctatgatatagataaatatatacatatatatgagtgtgtgtgcattgcgtcactaaactatgtttaatatgacagaaggttttcgtttaattttgccgctacccgaaaattttggcagttgcaatttataactaaaggaaccaccttattgtaaattcctcaacggaaaagctatggcttagctagggttgacaatgtcagtttaccatttaccaacgctgttgaacccgctggttaatgctatatttaactgtcccgaaccagaaagatccccattgaaaaagcttttcgctaatttaaaaacccgtaggtttatcctcctagcacctccttcagaataccttttgaattaccacgatgtcaagagcaaactgccgttacatgacctctgttataatgcagagtttattaactcttacatattgttaatgactgaaaactcttacataaatacgaattcaagggacagtcattatgaaacgttagatggtaagaccgttgttattcaatggaagaataatgtgatccatgccttaaatggatttcatataaggcgaagactaaagattctagagacaaaaatattacccaattttaatgactactttgaaggggcggctgattttatcatactattcatagatcaacctttaaattgcgaatttgtacctaacgactacttacagtgttttcacaattatgagaaaataccaaaaaatgcacatgctatgccaaatctgtcgatagattcttttcagcaagaaagatcgtcattcgagaatatattgcacattcatcctgctcgattaacacagcttggccaattgttttcgagttacagaacgctcgctcctggtgatgatccatctagaagtatttttgaaagcatcgtgcaacaagcatttgatggaatgaaatcggattcacttttcaagaacttttctaatctttacgatcttatacacgactattttgaactaaatctttacgatgatatatggtctaggcttactacacatttcaaaggccacgaagtagacactgaaaaaataaatatttttcagtgaaccagttgttgacagatttttactcaaaagattatggggaatttaaattacacgacatcactcttattgaaaggcgtctccatctagcgtccaaacatcttcaaaagttggctttgacccattcatacgctgaaaaatctaaaatattagttgaaactctacagaaattatcaggtactaccgaaatggattcacatcaactagaactaccagacggattgaataacatgacgatggatgcagacactttaattagcctttttgtgctcgttgtttgcagaagtgaacaaaagcaccttaaaagtcatctttactatttgcaaaatttttcgaataactcttcttctacaaaattcggcattctagggtatgctgtatccacactggaagcagtggtttgttatttcgaagacttcaacaaaaatacaggcaacgtggcgaaagctaacacattatgtgaaaaaactaagaatttattagataagttgtcatgtgaaaaccccacaaatgaagtagaagatctggcaacatacaaggatattttgacctacagaaatgagcaaggacaatccattctatccatatgtataacaaatcataaaaactacatcttattagatattctttctgaatatgaaaacgactttccagtagaagaccttttagaggacgaaacgattgatggttctacgctgcttatagaatcgataaaagcaggaaatttagaagccgcgaaagttctcataaagatcatgctgttcaattgtactgaagaggagctggtttcttatatcaataaaacagataaatatgcacgtaccgtggctcattatctaacccatgaaatggatatacttaaaagcatcggaaattatattgattggaaacgaaaaaattccagtggacaaacgcctttattttccatctttagaagttatgatcaaccaaattatgaagaaatggtgaagaccgcatttgatatcgcaaatacttggtatagaaagcacaacagtttgtttgactatctagaccacaccgataataagggcaatagcttgttgcatgttttgaaaacaaacattccaatccttttacaactgactaagctagatattaatgaggaaaattataagggattgacgccattaatggtatatgtgaagtacaaaagactaagtaatattgacgccatcacgaaagaccgtcgacttatattagagaaggttcaaaactcgaccttcttcacttgttttgattatgcaaaagatcactcggtactaagcaagataggagaaaggggtgtcaaagattcactttttggattaatatattttcattctttgcgatatcataatttaaatgcgacaacaaatataacatccgtttcaaatgcagagaaacctttcgccactactgttattaacatgaaaacaattcaaggcttactacgctcaattctgaaagacaatccgttcacctttttgccattaaatacctatatcgatgaaatatcgcacttaaaccgttctgatttaacaataatcgggaaaacagatgtcacatcgttacttcaccaattaactaactgcttcaacgttcttttattcctgaaaaaaattccagaaaatttgttcactgatgaggcttctatcttatattggatgcgcataaacacttctaaaagaaaccagaaaccctcaggaaaagaaaatccaaaaacaatggaacccgaggagattaatatgatacaaagctttttacgttttaattttgatgagatttcatcatttaaggcaagcttgaatattttgaggaaagtcttaatatttattaatttgaaatccgatgatttcgaggatgcttataagggtcttaacgaaatgggtagaaaattaattaatagtgaagcatccagcgcatttaaggggattataacaaatcataatatgttcagtgaattatcgctagcagcactactagaaaacgtgcgtttcttggaacaatgtactatccaactatctagtttcgttcagataattttatttgaaaaaattccgaactggtggaaacattatggtgagtttttagctttacataaaagctatcggaaggcttttcctaacatggttaagccaaaaagtgcatcagatacctctagtcgtgctccacttggtggttttattgaaacgaagcgtgaacaatcggagcaaagactagcggttcagataaaggcctcttcaaaaatgctcaaagaacttggaagcgaaatttttgtagctcacgaaaggttggccgaggaactaagcaattatatggagttcaggaaggcgtgcttagatcagcgtagtcttgtggcatttgccacaaccaacattagcgttcttcaagaatgtgtttaagattgactgagcattgcaatattttaccttcttctcacttgttctatagaattttttacccaaaaataagagataaagagtttgaaagaaacatcattacatatatatatatatacgggcagctccgtaactcgaaaagagtgacagctgttttactctgtaatagctgacgattcttcagtgattggaataacctcagaactcaccggtacgggtaacgtttgtatctcgcggattaacttttcgcatttcgacctactgagagaagaagttccttttgttaatctgtacctttatcttgaaagcagtcgttacagaggaacagcattgggaatcaccaacaaaataagaggaataagctcatccagtccacttcttatccatatagaaaccccttctgtatcaattcaaattaagtgatgtcttctagaaaaaaaaatattttgaaagtaatcatcctaggtgactctggtgttgggaagacctccttgatgcaccgttatgtcaatgataagtattctcaacagtataaagcaacaattggggctgactttttaacaaaagaggtgacagttgacggtgataaagttgccaccatgcaagtttgggatactgctggacaggaacgtttccaatcactgggtgttgctttctatagaggtgcagattgttgcgttttggtctacgatgtgaccaatgccagttcctttgagaatattaagtcttggcgagatgaatttctagtgcatgcgaacgtaaactcaccagaaacatttccatttgttatactgggaaataaaattgatgccgaagaatctaaaaaaattgtatcagaaaagtccgctcaggagcttgctaaatcattaggcgatattcctttgtttttaacaagtgccaaaaacgccataaacgttgataccgcatttgaagaaattgcaaggagtgctttacaacagaatcaagctgatacagaagcctttgaagatgactataatgatgccatcaatattcgcctagatggagaaaataattcttgtagctgttgagctgtactacttaattgtatcttctattatgtaatcctttatagcgtatccttaaaaaaattaataatttaaaactactaaatatatttagggatgtgatggccctttcaatatgaggctttcgattaccatgtgcaatctgtctatgaaccttagttaattaacacaactgttaaataaagcgatttactacacttgagataatataactcaacaaaacgtgacaaaaaatcacatgactacctaacaaaatatttatttttcttttttaatatttgaaaatactaaaatatttttgttgttttttgaaaaaaggatttttaatgtgtatgcgttccgaactttaaatataacgtcagcgtaaaaataatttttctccgaatgtatatcgaaatctcaaattgctcttagagatttagatttcaacgacaggataaattggctagagttgaaaaaactgcacagagtatataaaagatcttgcaatggatgattaaaatttacggtatttcatttttccaatgaatggcttttctaagagaaattaatttcgcaatttgttgatgagaagttctggctaccttagtcactatttattttactatggcggtataagtttctcccgccttgaaaaaaggaatacagtaataaaatgaatataaatcaggattttttggattttaactaggtaacaaagaattagcaaataactgcccataatagtattcttaagtttgtagatacatgtcaagtaagccagcttttgataaaacttaaaaattggtaaaccgcggatgtaccaagtgaatagctttcaaaattaatgttgtcactcttccaatgggcacctgtaagaataattaaaaagaaatctaggttcaaaacaatatttttgagaaaatctcaggaagcgacaggttatcatcccatacatacaatatgaatacaaaagcatggcaattttgaatagatatagctctagaaccgctcaggcgaaaaaaaacgctatatgagaactattgaaaaggaagaactaacatgaaagatgtttgttcatttcgtacctttagaaaaagggtattaatgctaggggtaaatattatatattatcttcgttaagggcaagaccatttattttatttagtattagttattaatggggcccaatcaatggactggtaatttcgtattcgtatttctttctactttaatattggtttaatctacggtaacaattgtggacttctgcttcaaaccttcctttatcaaagttagtttctctctaaagttactttctggatatcctgggatctcgccatattttagtacttcaactaagggatatgtggtgctttcatgggagggagaaatgtaggtcaccaatttacctccgtcggatattgccattttatgatgatctttgaaattgaactggaaagtaccatcacttagttcaaacataacaaatggtttataccttgtgtatcttctcaaaaatacatcatctttatgatattcttctctgccaaacgtagatactcggctcaaatttgccttcatgtacttggcaaaaaaatcaactacttctaaatgtctacttagctctcgtggtttttcgctcaataaataatgacttgctacccaaccttcccgatcgtcataactaatataccaaaactcttctgcatctgccaatcggagaactgtggtgccattattaaataagacaccaatatcctctgttgataactgataggagaatccgtgtttgttggagtagtcgacccacttggtaactatcattgggtgtttaattttaggcaatcttgatttcggaagacctcccattttatactgagcttctgcttctacaatgccattcaaagtaagatgacactcactggctaatattctcaaggagatttctgatttaatgacattggtcgatgtagctattaattcttttctcaaaacggcctgttgtgctctacgtatccttgcttcacgagccaaatcgtttaatcttctttgtgcctctatatcaacaacctccttatatttctgtttcgtcccgccaggggataaagaatgtggtaaaaatggtctgttttggtggtactcttctagtttatcgatactagatttaattgaagaaatataatccctcttttgacgctgaattttatcgctgctcatgctttctaatagtagagatttttccatgcaatctttgaagttaaccagtgactgctcttcaggaatatcctcaaaatttggtgcttctgacatgaccgtcgaaggaatagatggtgggaaagttcccctaaaccatacataatccataatttcagtcaaagagggcctttctattggatctaaggatagaatgtctcttattaaaatcttaccttcatctgagattggtttatctcttggaaacgaaaaatcacgacatttgattctttcataaatagtgtttacatctcttgcttggaagggtggcttaccaatcaacaaagcataaagcataacacctaatgaccaaatatctacttcaaatgaatgtccagaatgcttacccatcaacacttcaggtgcgatgtaattaggtgttccgcatatggtgtatttacgttcactttcattcgccaacacagctgccagaccgaagtcaccaatctttaagttatagtttgaatcgaagaagatgttaccaagttttaaatctctatgtataactcttcttgaatgcatatacttaattgcaccacatatttgagtggtgaaaaatctaacttctggttctgttaaaacttttcttctttttagtaattccattaatgaaccgttggggcatatctccaataagatatagacattgctatcatcctcaaaacaatcaataaactgaacgatatttggatgggacatacttttatgaatttgaatctccgacaacaacttttttcttgtcttctctgatttaattgaggctttagcaactgttttggcagcaaaaatttcgcctgaatcgtccttaatttggaaacagcgagcaaatccaccttcacctaaaaaatgacctcggtgatagtcttttcctcttgttttgattaatgaaggtggtgttttacacaaagctgataacttttcccttttctttttttgagctggctggtggtgatgatcattattcggatctagtctctttgtttgtttaaagtgattttcttttcctacgaggtctgcggtatttccctttattggggtgtgaactaacttggaacgggtattcaattgcttatcattgatagctttaagaggacccaacgacatctttattcgacttgatcttactctgttctttcttctccacggctgtgatttttattctctatgaataacaaatgtaacgtttatcgatgaatgaaagagagtatatatagagaagatataagaaagccaatgtttttgtgtacaaaaaataatactcagctcaattatacaaacttgactatgcagtttagcttttttgtcttttcttttttaagttttcttgaaagttaatgtagtatatgccacaaaattgaaggatgaaaaaataggaaaaaaagcagaatcagaatttgacacaaaaggcttattgttctttgaaactgccgcttgaattggatttactttctcagtgattctatatgtattgtacgaaagttgagtagcacaagagtaactgttcaagatatgccttgtttcaaaggatgtacattcaaagatcatcccaggtcctcgagatatttattcgttctatattttggattttctttattgggtttgttttgttttgacccttttaggtaatatcttttgacagagaaaagtccaaaagttcttccgggtgatgctacataatgccctacccgggcaacatatagaataaggtatataaagtaataatatgcagtgaagttaccaccgggtaacgcatctagaacagctgagatgaaagaggataggcttgatcgcagattttgcccgccctatcttttcaatgttccttcaacaataacataaattttgatgtaaaaatatgctggcgtcctcgtacgattccctcttcatttatcacagaagatggtgatgattctacacatctggaaggcaataacagtgcaacttcattttccgaggttcggttatgtcatgtgtgcttttatacggcaaacgccaccttgaacaaaggtataaaagaaaagcgctttttcactccaccgcaatctccgcgacctatataagcctatcactcgtacagtttataacctttaagaaaaaggattaatatttcgaacaaagaacagaacaagaaaagcaacaacagcaacaaaattctaaaatatggcacgttcaagaggatcatcaagacctatatcgagatcgagacctactcagacaaggtccgcttctaccatggcggctccagttcatccacaacaacaacaacaaccaaatgcctattcacaccctcctgctgcaggtgcccaaacgagacagccaggtatgtttgcgcagatggcctccactgctgcaggtgttgccgttggtagcaccattggacacaccctaggtgcaggtattaccggtatgttttccggatccgggtctgattccgctcctgttgagcaacaacagcaaaatatggccaacacctccggccaaacccaaacggaccagcagttgggaagaacttgtgaaatagacgcgagaaactttacacgttgtttggatgaaaacaacggcaacttccagatatgtgattattacttgcagcaactaaaagcctgccaggaagctgcacgtcaatactaagtttaaaagctcaaaaatttagaaaatattcactaaaatcatacatttcggtaatgttcttgttttaaccatgtcatttgacttatttttttttgatggtttttcacagaatcgcatactccacgtgagaacaagaaaaaatgaaaggaataaggactaaatgtcttatatatatggatatttatttgttttattttgtatgtaaataacttttataaatcaaatcatccaatttattgacttcataatcatttaatcatctgcacccccaccgcgcggtgtggctgacatttcctatgaagttctcaacaggggagggtaacgtagtaccttcgaagagtttgtttatttactatattttatgctcttcttcagaagggcctgtgatacgcatgtttctcaaaaagacacctagtgcagctgaaccggcaaagtaaagcttctgaaagaagacatgtcaatttctctattaggtagaattgtttcacaacaattctccggcatacgggcggctgagccagggagatctctatatttaccgtttaccttactattgaaacagcccggtgcttacaaggtgagcctacacagatatgtacatagcacccaaacgaagagccacttgagctttttaatgaataataacgatataacaccttttcaaaaatttacagttaaagttctcaaagagcagtgcaaatcaagagggttaaaattatcaggtcgcaaatcagatttgctacaaagacttatcacgcacgattcatgttcaaataaaaaaagtagtgtgaagataaatgaacccaaaaaaaagaggatattaataaatgatccaatcaaaatcacgaagaaattggttagtgataaaacttttagaactattgaaaaaaatatttcttcactgcagaacacacctgttatcgaaactccctgcgacgttcattcacacttgcaaccaagggatagaatattcttattaggatttttcatgttatcgtgtctttggtggaacctcgaacctcaggaatctaaacctaccattgaccattagaaatataattctagcactgtaattaattgaactgtatattctttcataatttattaagacacttttacttttctctacgctctcaataagttattgttgatccagatcatctcgatattgccgtcattttcggttaaggtaggcgcttttacgaaacacatgccagaaaaaaaagtgaggaaggaaggtacaatgaaaacagggtgaacgccacttcttttcacccaagttgtaagagaaataatagtaaaagcaatcgaatttggattctataaaacaccactgaggcgaaaaaaaaagtaatggacaattacgaaggcagtgatccttggaataccagttctaatgcatggactaaggatgatgatcacgtcgtttctaccaccaatagtgaacccagcctcaacggaatctctggtgagtttaacaccttgaacttttcaacacctctggacacaaatgaggaggatactggttttttaccgaccaacgatgtgcttgaagaaagtatctgggatgatagtagaaatcctcttggtgcaactggcatgagccaaactcccaatatagcggccaatgagacagttatagataagaatgatgctagagatcagaatatagaagaatctgaagccgacttacttgattggactaacaacgttagaaaaacatacagacctctagatgccgacatcatcatcattgaagagatacctgaaagagagggtttacttttcaagcacgcaaactatttagtgaaacatctcattgctcttccaagtacctcgccttctgaagaacgtactgtcgtaagaagatactctgatttcttatggttaagagaaattctgctgaaaagatacccttttagaatgatccctgagctacctcccaaaagaattggatcccaaaacgcagaccagctttttttgaagaaaagaagaatagggttatctagattcattaatttggtaatgaaacaccctaaattaagtaatgatgatttagtgttaacatttttaaccgtacgcactgacttaacaagttggagaaagcaagcaacctatgacacttcaaacgaattcgctgataaaaagatatcacaagaatttatgaaaatgtggaaaaaagagtttgcagaacaatggaaccaggctgcatcttgtatcgatacctcgatggaattatggtatagaatcacgcttctcttggaaaggcatgaaaaaagaattatgcaaatggtacacgaaagaaatttttttgagacactagtggataactttagcgaagtgactccaaaactatatccggtacaacaaaatgataccatattggacattaataacaatttgagtataattaaaaaacacctagaaactacgagtagtatctgcaaacaagaaacagaagaaatatcgggaacgttatcgccaaaattcaaaattttcacggacatcttactttctttgagaagtttatttgagagatacaaaattatggctgcaaataacgtagttgaattgcaaagacatgtcgaattgaacaaagagaaattggaatcgatgaaaggaaaaccagatgtcagtggagcagagtacgacaggataaaaaaaatcatacagaaggatagaagaagcataatagagcaatcaaacagagcttggttgataagacaatgtattttggaagagtttacaatctttcaggaaacccaatttttaataacacgtgccttccaggattgggcaaaattgaactccaaccatgccggtctcaaactgaatgagtgggaaaagctcgtcacaagcatcatggatatgccgatttctcgtgaataaattttacggagtgaagactaaccacttagtctgccaaaacattattgaaggatatccaacagatgtaattgacgtactaaacagagaaataattaggtaaatagagtaaagatatgtaccactataaattgttatttatttgtttttcaattttaaatacagtgtatgaagcctaattcggatattataggttcccatatttattagaaggtaacaaatctttcgataatttggattagatagccttataatatgccggacaaacgacgcccgctaaaaatgtgtattctccagtattcaatattcgtcataaatgatcttaatttgaaaaagtgaatgaactgaacatcgataagtcgaatgtggtccgtgtaatagctcaaatgggaaagtttttctaatcagcattctgtataacctcacctgcacgtaatctaaagtgcttttatcgattggtagtgcacatattgtctttcggcatcatatcacataatggcaaattcgccgaaaaagccatctgatggcactggagtatcagcgtcagacacgcctaaatatcaacataccgtcccagaaacgaaaccagcatttaatttgtcaccaggtaaagctagtgagctatcacatagccttccgtcgcctagccagataaaatcaaccgcacatgtatcttcaactcacaatgatgcggcaggtaatacggatgattctgttcttcctaaaaatgtatcacccacaactaatttgagagttgaaagtaatggagatacaaacaatatgttctctagccctgctggactagctctaccaaaaaaggatgataaaaaaaaaacaagggtacgagtaaagcagattctaaagatggcaaagcatccaactcctcaggacagaatgcacaacaacaatcagacccaaataaaatgcaagatgtccttttttccgcaggtatcgatgttagggaggaggaggctcttctaaattcatctattaatgcctcaaaatcccaagttcaaacaaataacgttaagatccccaaccatttaccattccttcacccggaacaagtttccaattatatgaggaaagtcggaaaagagcaaaacttcaacctgacccctacaaagaatcctgaaattttggacatgatgtcaagtgcctgcgaaaactatatgagagatatcctaacaaatgccattgtcatctcccgacatagaagaaaagcagtcaagataaattctggtagaagaagtgaagtttctgcggctttaagagccattgcactaattcaaaaaaaagaagaagaaaggcgtgtgaaaaaaagaattgcgttgggactcgagaaggaagattatgaaaataagattgattccgaagagacgttacacagagcatcgaacgttacggctggccttagagcaggtagtaaaaaacagtatggttggctaacttcatcagtaaataagccgacgtccttgggagcaaaatcttcaggcaaagtcgcctccgacatcacggctagaggagaaagtgggctaaagtttagagaagctagagaggagcctggtatagtaatgagggatttactctttgctctcgaaaataggcgcaacagcgttcagactattatttcaaagggttatgccaagatcagagattaattgctcatctcttatactgtctataatatttaaaggtatagtgtttcaaataaactaggatataaaaaaaacaagattgactaacataaagaaggccggttggtgtcgcttagtcaagtcatcgccaagctattgaggaccattcaacctttttgctttgttcattttaactttataataaggaagatatatcaatccttgaagttaggcatccttctaccaaaaatagcggaaagaggagtgataatcgggaaaaaaattttcatattaatacacatttttatacatttacttgtcattatccttttgggtgaaaggatgtattatgtattgtttctcagaagggcttctaaattagtccaaataatgctgttatggcacctaacaaactcattagagtattagtgttcgcataggaaatagccgcagcattcgctttgtttgccgtagaggaagaagaacgagctgtagaggaagaaattgaagaggatgaagaatttgagtttaaagttgtatttgacgaagagtttgagttagaagtgacatttgatgaagtcgaggttgttgagtttgatgtagtatttccggaggttgatgaacctaagagagccgttattggaataccgtcagtagcctcagagattgcagaggcaatagcaccgctttgatacgtactatttcccgatagttcaggattagctgaggtacttagtgtgccgttccagcagtaatccgcaaaacatttggtacattcagggggcaaggtggcatttaggctttcttgcttacgtctaatgatggcacaacctatgcaacctaaaaagttagagtcatccgtaaagttgcccattgtagcagcttcaaaaccatttctgatcattccaagacgttctgtaacattgtagttcatcttcaaagtactttggttaccattgaatgaatgttttgtgtttgggatatatacaactaaaggtggaatatactccaagtccgtcaaattttttgcatcacaaccaaaaaacgttggcttattagttaagcccaagttaaggaaggtgttaacgtctggaacatatgggaaagccattcctttaccttgcttagaatactggcgctcataagtgttcgtcatgcacacaccacttggccatgattcatcagtattgtcggatatatccaatgcgaacaccacatccaagtcacgttccttcttgattagtggaaccaacggcaaattttggccgtcctcaccaccatcaactaaaaacaaatcatcggcatcaacaatactggaagtgtaattgcggtcaacaaattctgtatccttgaatggatttgcagcgtaaattgcaatatcatcgtcatcttgggataggttgttaacgtacttgttggcaaaactattaatcattttataataggtcgaagtggaagcttccagggaaaattcgttgaataaactggcggatgtggcaattacaaatccagcattatcgtaaccagaaacgcattgatccttgttgaccggtttaccatttgtaacgttggtacctagatatttcacatccgtaaaagcgttcaaagaaggatcccaagaacccatttcaaatggagtgaactcgaaaagagtggcattcaagtttatcacggtggtacctgggtatctaccatctgcaacagtaattggtaaaggcatttcaccgtttttgaacacatcaacatctctcaaagaggaccaagtcaaagcggagccagcatctggcaagcttggaaagaagttgtaagaaagtgcacgggcccacaaatccgacaaagatatattgaagcctgcatcagacttagcctgcacttcttgtacaatggactcccatctttcaattgtgtaggtcaaattagagccaccagggttcacaatggatttcgtgatattccagatggaatcgctctcactcatatggtctacaatttcctgtacagaggtccaattgttccatgccaaagtaccagtcaaccagttaccaccggacaaacccgatagatacgtggaactttgtagtaaaccaccaagaccatgctcgttagcaccatcagtacgattgtccatagcagcaatcataccagcaccacccaacatggcacgataaccaccaccagagcatgcaataccaattttgggtacattggaagagttactactgaaaagagtggatagcaaagaagtgtcactgaagttagaagtagctctgcttaagaaggaatgtaaagcttctttagtgtacgcatctcttttctttaaccaatcagtttcagcggtagataagccagacgcgtttctaactaaagaggtatcatcactgggacaaggaattattgatggagcataaccatcaccagtagtggacgacgaatctgcagcgagcgaaagtccagaaattagcgagctagcctgtaatatgttccgtaattgcatctgcgtaagaagtgttactttaccagcgcgagtgaattttaactcacttctaacccttgataagatttgaaggcacactaaggaaaaacaagctaaaagacatttctaacgccttgtaaagataactaattgtgctcatatataaggtatattctactccacatgagatacgaaaagaagaagattctcagactatttaactctttgtcctttttttaccttttttttgatttttttttcactttcttctgttggtaaacaatgccaaggtggagaatatgcggaagaaatgtccgcaaggtaaaaaattgttgaaaaaggcgacgcgtccctttgtaggagcttttcgaaggcgtatacgagccaagaaaaaccttatttcccagtttggccagaccggctgcattgggtgcgacggtaaattctctataggcatcaccattgaaaagtatgtccttaatttagtcgtgagaatcatcattgtgttcgccctttgtcgtataaccgaattgagtgtctttgattcatctctaaggtgtaaaagcagaaaaaccagattatctaaagctgcaagaaagaaagaaactgatcattttcatgaacagtgcagatatgtggaagtgaaatttggcctgcagatggcatatctgcaatcctagctttttccttctgcactttaaacctatctatatatcttcgatgaaagtactgcatgaacatatctgtatagatagatatatgtagggaagacacccggtatgtaaatgttaatgctcgtaagatttcgagtttgtaaaaataagatgcggtatgcacttgagatctcgtaaactatttgtatgttgatatttttgcgcttttctcactctcgtattcttttagaaaagaaatagaaacgaagaaagagcctaaattagaccgaagacggcactaatgacacttaagacaccaataaaagtgttagtgtttaagttagaataattcaccaaagcattgcccgcatttttcttatgagtggaagacccagaagcagaggcagaggcggaagcagaggcagaggcagaggcagaggcagcagcggcggaggcagacaaggaagcagaagaagaataatcatcatttcctacacctgagactgacctgctgtcaatagtaccgttccagcagtagttggtaaaacactggctgcattcagagggcaatgtagcattcaagttttgttgcttacgtctgataatggcgcaaccaacacagcccaagaaatcagaatcatcagtaaaattacccattgtggcagcttcaaacccattcttaatcataccaagacgttctgaatcggagtatgacatcttaaaagtactttggttaccattaaatgaatgtcttgaatttggaatgtaaacaattaatggtggaatgtactccaagtctgtcaaatttcttgcatcacaaccaaaaaaggttggctttttgttcaaccccaagttgacaaatgtgttcacatctggaacatatgggaaagacaaattgagaccttggctgccaaattgacgctgataagtgttaactaatgaagcaccatctggccaatagtcgtcagtatcagcagaattgtctaatgcaaaaataacatctagttcacgttccttttgcaacaatggaactaaaggaatattttggttatcttcaccaccatcaaccaaaaatagatattctgattcgataatactggaggttgcgttcttttgaagaaaattagcttccttgaatggatttggggcgtaaattgcaatatcgtcactattgtcggataaatcttccaggaaatcggtggctaagttagcaataaatgaaggtaaatcggtagaattcaatcttagtaaaaattggttaaacaacgtagatgaagtggctgttatgaaaccagtgttatcaaacccggcaatgcattggcctttattaactggtttaccgtttgtaacgttggtacctaaatacttcacatccgtaaatgcgttcaaagtggggtcccatgaacccatttcaaagggattaaattcgaaaagagtggcattcaagtttatcacggtggtacctgggtatctaccgtctgcaacagtgatagggaagggcatttctccattcttgaagacatcagcttcccttaaagttgaccatgtgtaccctacaccaccacggtgtaagcttggccaaaaattgtacgcaagagcacggccccaaacatccgccaaagagatgttgaaaccggcgtcttttttatcctgaacgtcatctgatatgtcgtcccatctactcccagtcttaaagatgttaatgccgtctggggtaagaattgaatgagagatgtcccaaattgagttagattctgttgtattatccacgatagcttgcacagacgtccagttgttccaagccaaagtacttgttaaccagttaccacccgacagacctgccaagtaagttgcaccttgcagcagcccaccaagaccatgctcatttgcgccatcagtacgattgtccatagcagcaagcataccagcaccagacaacatggcacggtaaccaccaccagaacaggcgacggcaatcttaggcatattggaagagttgctaccaaaaagagtggatagcaaggaagtgtcactgaaattcgaagtggccctattcaaaaaagaatgcaaagcctccttggtgtatgcatctctttttttcagccattctgtttcgttatctgacaaaccagatgcttctctgactaagttaatatcatcatcacaggttacgttcgcagggacgtaactgttatttggtgaccaagcgttaacgttctctgttagagaagtcaaaactgcagcagaaaccaacaaactctgcaacttcatggttttgttttattttctttcccgtttgcccttaggatggatagcttcgtgtaatttacgttatatgaacgaaaaaagagagaaatgttaagaaaagaacgaagaattgattagttagtataacctaataaatgtagaaccttacagcgaagagacgtttccgttggttaaatgtggtggaagcgtctttatatattagatgatgtagtttacctaagcagttagaagaaaataaagtaaccaagtcatcttctaagcaaaaataggagacgtaaatgaatgttgcttaactgagaaaaatatgcgggaataagcggacatgttactgtatgaggttatttccctttatagataagggcgtaaaccgcatataatgaggaaaggcgaagttagaaacggactttttaggtcgctttgaagaagtccgtgcaggaaacccatgcgtccacttattttagcactatgtggcatgagaaagctttggaaggaataaacgttaggaccccactgcgccgcttttacgcagggcaatttcggggacaaagggggctgaaggaatacaattccgatccaaggcaacaagtaggtcagaaccctttattaacctgcgcttgttagtggcttcctttgtactctgtccgtaatccagcatagcgctgaattgctgaaagatatgggtagcggtcagatgagaagggcaatcgtcaggacttctgttgaaaagcggactaaacataggcattatcattcttagagttttacgagcaaatagaatcgagtgacttccgtcgttgctaacaggcgcagtaataataaccgcggacgaaagccacgcaggcaaagaatgctttcgctgaaatatcggagtcttgctattgttcagggctttgccggtgcgtaaataataggctgaagcgaatttgatttcccgcacaaaaaatttttgctcgagtaagtcatacatatatcttgcatgcgtaaaaaaaattgcaattgctgaagattgaacgaccgcccaccggtattttcatctcttctagatcaagactaactgctcgttcagtacaagtattttacgatagtccatattactcttcaattaatattttttttttatattctggcccgtttttgacacaattttttccttctctttttctccctataaactatgcagaagtagcgataatcacgatcttgttaatgattcacatgtgcgcaagtcgtattgtctgtctagatagtgagatgccttctaaataacaggagagaggcaagatagcataacggcgcaatgaaggtaatttctgccagttttctttgcattgacgactgaaagggcccttgtaagagccgctcgacagggcgacgccacagtagagtcgctaacaccgaaatatgcatattgaaaaacatcaaagtataaaagaacaaagagggtggcatctgcagatcaaaaaaaacaataaccaccaaacaagacactaaaaaaggtcgtaaaaaggtcaaaagttagaatggttaaggtatatattcatgacaacaaggttgactccgattatcgcgcaccccacaattctggaacagaactttccctggatgaattagccaagttaggagtgatttataaatactgtgcaaatgaggaagaagtgaatgaaattgctaggcaaagagaatataaaaatagagatgtggtcaacatctgcgaaggttccttcaaaagtgaagcagagtttaatgaaaaactagcaacattctaccaagagcatttacatgaagacgaagaaataagatactgtctcgagggtgctggatactttgacgtcagggatgcttccacaccagagaactggattaggtgtttggtagagtcaggtgatttactgattcttccaccaggcatctatcatcgtttcaccttgacaactagcaaccacatcaaggccttgagactgtttaaggacgagcccaaatggcaagctatcaacaggtcaaatcaggctgattcattgcctgtacgcaaggactacattgccctgatcaatcagtactaaatactgcatcataatacattattcttaatgtcttacttctttatatctttaaagtagcgtagggtgacttccccgtcaagaatgatttttagtctgtgaaataggaaaagaaaaaaacaccaaaagtggaaaaagaaacaccggaagtttgaacgattttcgtattatttttatatttagatgttggtcaagtattcatcttttcctccatttatttgcatacttcttccatggagaatagtgaaaagtataggccatagtcgtaatatcaaaaagcaaagccttatcactatttataaacatcaacaatcctgaaagccaaaaacgatacgacatttgatattttgatttggtttcagcgccctattttttttataaaaactatacgcatactgttgcattcctttctttataaaattcaataaaaaattaatactttccacagataaagctagagaatgtcaacaacaggtccgttagatgctactttaataagggacgttgcggttgctactgccaccaaagcatcatacgatatgagcgatactctatattcatatctacccaaggtcgaccaattttatattcctgaatggcttacaatgcaattcattgccaacaatttgatcagctttacccccctattttcatatggtaccacgatcattagcattgagaaatgcaagactgctttagggttttcaatagatatttgtgccacaatgttgatcgctagtatcctaagaatatcttactatctcattacaccgtatgaaatcactttgttgaggcagtcattagtgatgatttttattcaactgatcttgctgagaacaagcttaaaatatagacctgatgagtacaaataccaaaatctcaccgatgtagagtcattgtcacatttgattcacgacatatggttcgagttttttagctgcattaatagaccgaaatttttaagtgaagattggaagaatctgatcaaatctctttcgttcacaaatttactgaaattttcattcaaaatttttttggcatttttttataaaattttgaaattctttgacccaaatttcaaaagaattggagcgttttggcagtgggatgacgacaaaaatttctggaggtttttagctctttttgcaactgtacaaatattggtcacatttttcatctctaatattttaaattgggactcactagctcaaggactgggctctatcatagggtcgttgggtttattggtggagtcgcttttgccgttaccacaaatcgccattctttataaattgaagtctgttcaaggtttcaaattgatccttttggtaagctggctttgtggtgatacactgaaaatcacttacctgatatttggtgcgaaaaatatttctgctttgtttgttatttttgcattatttcaaatgtcattagacttttacatcggtggtcaatacatttactacagatactattatccaaagttaaggcatcaacatcaccctaatgacagtaattcgccatcagatgaagatgaaagcgaaatgtacgaattagatctttttaataccttacaaaaggatgtcgaaaaggccttgaaacaggatagtaatgatacgtcagattcacctcaagatgaccaagtgggtaaatctcaggcacaggcggtaacgctatagaaattttcaggtttgcaaataaaaaaagttgatagagaggtttttttatattttagatatatgcattcataattcgatatatacatgcatgcatatctcgagtacaatattaccattgttgtaattacttgttaaatatcgcctcttctattcatgtttgaaaggaaaagaatggtgtggttacacctcggggaagatattttcacgggcatatggaactaataaattgaacgtcacggtaatactacataatacagtattggctaaacaaaatgtgcctgacgatatcaaagtttctgtagtgatattcattcctggtttgcaggcatgaaaagattaatattgtcattgagcaatgttcaattattgccttttatttaataacattctacaacctctgtatataatacatataattccatttgtatccacaattctcttcatgttgagatatatatcttgaggggtattcgtatcgcttgtatacaatgataatcgaggtaaaactcatgtacagtagtgcggcatatttttcttatttagtttttgtaggcggcatagtattacttgcagatttttttaaagtccctgagccccaaagttccaaagcaacaaaaaaacataaatcctttgcaggaaaagtaacatttggcaaaatttcaacaaattatgccccccgaatttagcagtgatcaatgttaatttgcctacatgctgatgcagagttgtagaaacaaagaattttaccctgtatgaaaaattttctaccgatgtaatacaaaaatgaatcatcaaaattttatgacgtaggaaaagacagagaaactttctatttcttttctggagtaaaaaattaattatctattttacttaaacgaagatagggtttcgtaatcacgaaagaacaagcaaaattctagttgacaggtcagttaaggcacagaaaaagaaatattattcattactatcaagataccgtagaaaagaaaaagaaccggggatgaataataacaaaacgggctgctttttctttttctctttctttttcatttggtccctctccactctttctccacgtggctttgctttccccgtatttttcttcgtcagagagactacatgatagtccaaagaaaagaaacggggggacgaagaagaggagaggaaaaaccaaaatataattttccgtgaaatagattctttttctccactgcacgacttcttctcctcccacaaaaaatgacgcctcatagacagccccgcagcttcacttttaagtttctttttctcctcacggcgcaaccgctaacttaagctaatccttatgaatccggagaaaagcggggtcttttaactcaataaaattttccgaaatcctttttcctacgcgttttcttcgggaactagataggtggctcttccacctgtttttccatcattttagtttttcgcaagccatgcgtgccttttcgtttttgcgatggcgaagcagggctggaaaaattaacggtacgccgcctaacgatagtaataggccacgcaactggcgtggacgacaacaataagtcgcccattttttatgttttcaaaacctagcaacccccaccaaacttgtcatcgttcccggattcacaaatgatataaaaagcgattacaattctacattctaaccagatttgagatttcctctttctcaattcctcttatattagattataagaacaacaaattaaattacaaaaagacttataaagcaacataatgtctgaattcgctactagccgcgttgaaagtggctctcaacaaacttctatccactctactccgatagtgcagaaattagagacggatgaatctcctattcaaaccaaatctgaatacactaacgctgaactcccagcaaagccaatcgccgcatattggactgttatctgtttatgtctaatgattgcatttggtgggtttgtctttggttgggatactggtaccatctctggttttgttaatcaaaccgatttcaaaagaagatttggtcaaatgaaatctgatggtacctattatctttcggacgtccggactggtttgatcgttggtatcttcaatattggttgtgcctttggtgggttaaccttaggacgtctgggtgatatgtatggacgtagaattggtttgatgtgcgtcgttctggtatacatcgttggtattgtgattcaaattgcttctagtgacaaatggtaccaatatttcattggtagaattatctctggtatgggtgtcggtggtattgctgtcctatctccaactttgatttccgaaacagcaccaaaacacattagaggtacctgtgtttctttctatcagttaatgatcactctaggtattttcttaggttactgtaccaactatggtactaaagactactccaattcagttcaatggagagtgcctttgggtttgaactttgccttcgctattttcatgatcgctggtatgctaatggttccagaatctccaagattcttagtcgaaaaaggcagatacgaagacgctaaacgttctttggcaaaatctaacaaagtcaccattgaagatccaagtattgttgctgaaatggatacaattatggccaacgttgaaactgaaagattagccggtaacgcttcttggggtgagttattctccaacaaaggtgctattttacctcgtgtgattatgggtattatgattcaatccttacaacaattaactggtaacaattacttcttctattatggtactactattttcaacgccgtcggtatgaaagattctttccaaacttccatcgttttaggtatagtcaacttcgcatccactttcgtggccttatacactgttgataaatttggtcgtcgtaagtgtctattgggtggttctgcttccatggccatttgttttgttatcttctctactgtcggtgtcacaagcttatatccaaatggtaaagatcaaccatcttccaaggctgccggtaacgtcatgattgtctttacctgtttattcattttcttcttcgctattagttgggccccaattgcctacgttattgttgccgaatcctatcctttgcgtgtcaaaaatcgtgctatggctattgctgttggtgccaactggatttggggtttcttgattggtttcttcactcccttcattacaagtgcaattggattttcatacgggtatgtcttcatgggctgtttggtattttcattcttctacgtgtttttctttgtctgtgaaaccaagggcttaacattagaggaagttaatgaaatgtatgttgaaggtgtcaaaccatggaaatctggtagctggatctcaaaagaaaaaagagtttccgaggaataagagattatacttaaactagcactgatttttttaaggctaatggctactaatactttaatagatgatcttcatacttttttatttaacgatttttaatgatgtttttatttgtaccactcatttatctagatttttttaatactgatcaaatcttacggactcgacgttaaaaagttcctacatacgtctggtacttgaaacgctgcttcgaggtattgacactataagaatacgatccaaatacttacaccgcatgtaaaaatatgccgacaatatgaatacttgttgatgaatgatatttgattttaatccggcaatttacctcctttatataatccaataattgttgataattagtggttaggttgcagtactaataagaattaagacaaatattcttctactatataaaaggtgcaaacaaaacacacgccgatcggccatactaaacaagaccaacataataatggtggaaccatttactgtattttcaatgtaacgactcatatccttatacatgagacgtcaagtttctcgttgaagtaataatgaatctttaactttactgtgccacatatcacgtaatcatatattgtttttcgccttcaagcatcaatggcgtattgtggctgattacttcatatgatcactaattaactaattatgaaaaataataaataagtcaccaaccaagcaaggaaattagcttcaagtaaacagttggttctttctggcgagttagaacaaaattaaacaataatctatcgactagcattcatatcaccaatatatcgtcatatacagcgaaatgattgcatttactggattgaatggatacactttgaagatgaacctttatcatagttgaaatgggatagctgagaaacttgtgcatgatttgatgattgtttgggttcaaccgttggggataaggactataatattaggtacacagaaattccaaatatataagtagcagtgctttatgaaactataatgtcagagtagttatgtaaaaatagaacaattgatatgatcgtttctttaataactcgataaggagttctctacgaaaaatatcaacagtgaaatataatccgatatagtgtaacggctatcacatcacgctttcaccgtggagaccggggttcgactccccgtagcggagttttctttttgaagaaatttgaaaatttttttcttcacgtcgaccaaggttttttccggtcaaacatggccaataaaacggataccatttcttggaaattatacgcttcgaagtattctcaaaaaaggaaattgtctgcagtgaagattggatataaggttcactaaacacagagtagtaattgagctgtaatttgtttacagaacgaatcaaatcagcgtagtgttacagtttatctgagactgcatatctttaatctctatgagcgagaaaaaagaagaagttaaaaacgccaccgttaaggtgactgtcaaacttccaaaagaagataaccattcgcataatacgaaacatctcaaaaagacccaaagttcaaaaaataatgatatatcttttgaaatcggcaaggaatccaaaattcaaactgttctagatgtgttggctatgattccaagttccaagtacctgacaaacgttgggctgaaaacaattgaaggtgactcccagctatctgatgaaatgtctataaaggaaattgttggtgagaaaagcgagttaaaacttcaattgatactgaagccatatagcgcaagagaggctttgaaacatgtgattactgttcgcgatttcatcggatttgcccaagaaacctcagatggattatctgaatttgctatttctactggttcaagcttttcctcgttaccgttgggtcctatcaaggaacgctcaaaacaagaagaaaaagacgagaagagcgatccagaagaaaagaaaaatactttcaaagatgtgactgacgaggaaaaactaaaatttaacgagatggttcacgaagtgttttctagctttaagaattcttcaattaacaaacttctcacctctgaatccaacatcatcacgccgtgcgtcaggtctttgagtttcgcaccttacaatcctgtacctccattttatagaagtaaaggtcatctattttacctacaaattgtcactttggaaggtgagagtttctatatcactgcaattccatctggattctatgtcaataaatcaaactcaactaagttcgatccttctccaaaagaaaacactgacgagaacgcgcactcatccctgatctattacagtctatttgacttgattgcttctcgctctaaaaaattcatttctcatgtccaagcattcgagaaaaaactatctgctttagattctacaagctatgtaagaccaagcaatactttcttgcataaaccatggtttgtttcttcattgccaccaaataacccagattatctgaggttacaaactgccgccttggataccacgccagaaagaaactttaatgatgaatttcaagccattaaagatttgactacgtcaacattacaagatcgtattgaaatggaaaggttgttttctaaagttgtacatgaattttctgttactgcagcatcaggcgctatgtcaattttttacagtgatttcgttgcaatgaacccagaatctccaactcgggatcaaattttcttaaaagacaatatcttttattcctatgtttccgacgttagtggcaattatgaagggaaaggtggggatgaagctgcaatcgctgcttccaaccaagacttgaagacaatcaatattttgaatcgcttgcatatgcacgaagttcgttatcttttaacaactgtagtcgaatttgcaggcagaagaattttggctcaaactccagtacctggactcttagctaccatgggtaacaaaattgtaaaagatgctaataccggcgaagaggttaccgaagattttgtcaatgatattaatgtaaagtacggccttgatgaaggtttgggaaagattgtttatgatgctgactttgattctgttttagaaaaaaagtttgtcaaggcattccatttgaaaaagcacaaagtcaacggtactgaattagcattttcatcgcaatccaagggaatagttggattcgataagaggcgctatattttggatttagccaacacgtatcccttggacatcaactttgctagacaaaactttgacaacatcgaagagactggaaaccgttacccacacaggcaaactttgttacgtccggagttagtagaaaagtggtggaataataaagttgagaaggaaggtgttgaatttgaaaaggcctatgaagaaaatttgtttagttataaccctgatgcttaccaggtcgaaggtattgaggacgctaatgttgacgaaatgtcgaactacttacaaaaagaagttattcccagcgttattcaagattatttatctggaaatttgagcactccttataatggtgaacatttagccgatactttacataagaatggtatcaacatgcgttacttgggtaaaattatcgagctttctcaaaaggaattggactcccaaattgtccactacgaacaaaatttgaaagctgttgaacaagacaacaaagaatatgaggattgggaaaaatcttatctgcaaaaaattgagaacatgattaaagagagacaagccaagattaataagctggtacaagaaggcaaagaggttccaaaagaactaactgaagatttgaaattaaacgatgaagaaatcaaaaagcccaccgatggaaaacctgtggtcgttgcctatgatgagctagtgccattaattaaaatttccgaattagaaattgtttcgcgttctttgaaacatgttttaaaagatttgagtaaagatgttccggtcttcttggttccatcactggtagcatacgttttcaatatgttagttggtatcaactacaatgctgatccgaagccagaaccagtcgacgaattttatccagtcaataagtgctcatttgctaaattaacacgctccgaattgctggaagctgtctctaaacaagccttcttgcgtttccgtcatcaattaccatccaattggatcgaagcttacatggaaaatcctttcaccctcattagaagtgtttcttacaaatttggtattcaattgctcaataaagaatacttctttactagagaacaattggaaagttataagcaaagtcttgacaagaaaattaggaacaagtttgtcgaaccaccaactaccttcagtttaagcgatttgaccattattccacgtgttaagttctcagaatatacttcttcagttagtgaggaattttgggctcaaggtgcttctatgatcaacgaagacaaacaaagtgctttgactttactcgctcaatcaattacagtcttagaagatgttaacaatattttacatcccgccgttgctgaaaagtacttgtcattatctgccatttataataagttagcattataccctgaagctatcgcgttctgtcgtaaagcatgtactatttatgaaagagttagcggtattgattcttttgaaatgatgagggctttaactaatttagcaattctagaattctctaatgaaagtccttataacgctactgtggtttataataggctcgcagaaatcctaaaagtttatgagttaccaaaaatccatcacccagcccccacaagcattttcaaccatttggaacaattagccctaggtgttcaagataccaaattggctattgaagtcttgggacaactaagctcctatgttgtggaattagaaggcaaagattcattagcatatggctataccgagtcacgtttaggtaatttgtttgcagcattgaaggatttccaccgtgcattagagcacatcactgtaacccaagggattttcaccaagcaattgggtatgaatcacacgcactcagcccaatcaagacagtgggttaatggtttaagctcattaataatggatttaaaacaaaagaagcaacttgcacaagatcaaatgtcgacaacgggatcaaattcagctggccataaaaaaaccaatcaccgtcaaaagaaggatgacgttaaacctgaattggctaacaaaagtgtggatgagttgttaacatttatagaaggcgattcttccaactctaagagcaaaaacaaaaccaacaataaaaagaagcatggtaagaaatagagagctaacttaacaatctcgtttatttattatttttctttatatctatagcccatacttgtatatactacgtgtaagtactagatataaaacgaaaaaaaaatacttacaattatttttttttctttactgctctattcttttctttattctattcataaatgcaaacaattagttatgtaattttaaaagttgaaaataattgactttgtcaaagagtaattaatttttcacaaatcatcataaatgcaggtatcaaaatattgtcattaagcacactattaccttctagcactccactcagtgtacaaagggtaagcaattgtaaagtagttaggtggttaaaaattgcagctttatcaaaacgtaacaataccaaacaaacgataaaactcgttactataaacgcaagagttccctctaaagttttttgtgtacctttccaacgaatgcggccataccttttaccaataatagatgctaaggaatcaccaattcccaatcctattagacccattggagagttattcattaataaaggtgttgatattccgaagagtaaataaaggtatgatatgatcaatggcccgctgtggtccctatcatcagcaaaccttcttagttgtaattcaatagcagatcctaacggcggtaggttttgaaatcttatgtactcaattgataagaagactggtattgttccggacaatgcaattttcacaaagtttgaatccatttggaatgacggtattatgagtaagaaaatgatgaaatgccacaattttcgggaggtgttcaacgatagactgtccttctcgatcaatatacttggtatggacagtataagaattgaagaccaagcaaacaaaatcttttgacgaatagtagactctaagatatattttaccagccaaagtagcggattttcaccgtcttctaaatgaatgaaggtattggcaaaaagtggaagcccgatggcaaaggatattgacagcataaacggtttaaagtgcattacctttttgagcacatagttaattgaaattattgttgtgagagcaaggataatgcccttcaaaattctaaaatgtactgtgccagcctctgaaacgtacagaatattggttaataggatactaaaaagattagagtcgatattatctaaacttttcaattgcccaatatacttcaaaattaacgacagtaaagaatttattactatgctaataatattctttaacctgtcaccagcctcaaaattaaaaaatatgaggcagagctgtaaaatgatcactaccaactgagttcgccatctatatgaatttaataccgaaaggatcaaaatagtatttatcaccgtagatgatgtatcgaacaacaacgaaaccataaacggtaaatataaactgtaaatggtatcgaacttgggtaggcttttgtaaccatgttgccaatattttgtgaatatcagaccaaccattatcaaacacaccacaaagacatttacaaagatttgtttataagatatatcagcggtaacaatggaccacggctgaagcctttcaacacagtaaaaaaaagtgcccaacaatataacagtttgaacaaaattcgaataaaagcactcaaaatctcgagaattcccgcccacatcaaatttacgagtcctcatattgattttgcagatctcctcagttggcatttggcttccctcagttttctgggttagtttaattgtggtaaaggaagcatgaggtattatagcgaccatataggcaatgaacagaataacgacagtttattgcctcgaaaggagtctgatttactagctaaattctaatatttggcttactacaaactctatctttcatagaatacgtccttcgataccattttcaccatcttgactaacaacgtgtacaactcttttgaaaattacgtgcctgaaaacccaaccattgcggacagccctcaataacgtatcttagcattacccgcacacccatacatctagaacttttttcatttctgaaaatttttttttcttctaggattacttcgggtataaataagagacgcagaaatggttattggcaattaatgcttcctctctttaataagttacaatattagaatcctatgatttccatcacaaagatcaatacaaaagaaatattcagatgagtgggagctatgaaaggctgagagagaaattgaatccataaaacgtttttttccgtgttctttttttcttctttatcaaagttagtttttcagatatgtcttttgtcattatcacaggctaattattcccttgatgaccaaaataaatttttacaaactagagtttctgaatcttttgtgattagaacgtttattcttatttctgaggtttttaattagcaataaagaagaaaaaactgaaaggaaaagtctaaatagaaatacagtagtatttcttcaatttctctgctctcctttcatttaccacacccatttcaattttctttttattccatatttattcaaaggtgtttgttcatatgatgattataacaaaaacaaaagctggaattactggctgaacgagtatatgttgatacgtttttgcactatcctgacctagcaaacacctttaaaataaatactagaaagttgacacatttccataaattggaagaatacatttaagcttagaaaacagtagttttttagtgctattcttccgtagattgatgttttcgatctatttgatacaatggaaatgaggatccacagcactgggcactgagggggaaacaaatatcctttcaaatgagtgacaatgctttagcgggcctagaaaacccgcgcaactgatccattgtaagtttttctgagggctaacagaattttctatagggaagaatggatttttttctcattttcgtataattatgtgaattggtttttatgatgagatatttatagatgacgagtctgatcattcgtgaagacacaactattaaaattaccattcatgcctttctgaagctgtttacattattcttttcgattagcaaagaatttggaaatagaaaaaaatcgacagataactagttcatcagttgatgtgtctgtattgcttccatgttttttaaagaaaatttctaccttagagacgtcaatgctgcagaagatgaaacaaattactcaaatagacaagcatatgtctgatcttcatgattgaaaagagcaattagtgtctgatgcaatttaaactagaaaatttatctgagagagatgagagatcgtacaaactgtttcaaggtttttaacttttctccaatttcaaaaattgtttatgatgatttccacatttcacgacggtcaactgcgtttttcgaatgtttatcgattaactttgatgatatttcgcctgtgacagggcgtggtactgagctttaatatttttagcaaatttagaaattgggtcaagcgaaccattgtaatgctgactatttggacgactctaatctcttcaatatatttgagttcaaatatattaacttgagtaaattttctcttgcgttaattataactaattgtgatgtgatgacaacttcttgagctatatattttcttgagaacatcaatgaagaaaacgtctcatcaaatgatttgcacgtcagtctgatcacaagccatataaaattctttaagtattttatccattctacctttttcatctgttagtgatcgattaaagcaacacccagacattacatggcccatatggcaaaaattttcatctcatctacctcatcactgtgtgcatttagtgtatgaatgactactttaagcaatttaaccagtatatacgtataaagaggtcaagtgtacggataacccaaaggaaacatgccttccgaatcatccgtctctatctacaagcttgatcagttggagtatcagtaccattatttgacaaaatcattacagaagtttgaaccaagatatccaaaaactgccaaattatacaattgtataggtaaaaagaacaaaaagaaaattgaaaaactgttaaactctttagagttgaaaactttggacaaagaactagatgaaagttactcaaagttactcaataataagattcactattacgagacgcatttatcaaaatgtataaaagaacaaattcagaaaatatccaaaaaaaattctagtaaagtgaaggatgctcaaaaaaataaatcaccctctatagatattgaaaagatgcttgctacgcagttgtcattagatgatttagcactcttcatgacaagatttaggctgatcaaaatcttacaccagaggatcaaacaaaaaagcaaaaagattgaaggtgatacgaataataaaacttggttgaataacaatgattatagtggttatatcaatgataagacaagtaagtggaacccaagcaatatatggaatgaagttattacgaagctgccaagttgtgaaaagttaaacgcactaattggtcaaagtaaaatcgttcaaaatctaaccgaatcattcgatttgagtatttgtctcatatttggatttgatgtaagcgctatgaaagcaaagaagtatggagcaagggagaagacggccaatgctaatcagacgcactccaacattgactatgacaccgatgacggcaatgaaaagaatgccatcgatagcaaatctaatgcgatcggcgcacaaactcaaagcaataaagaaacaacgtccgacaatgaggatctattgataaaggaatacgagggaatgctaggcagttcaggagatgaaggggaaggcggcggatacttgaaccctaatatcaattacaatgaagtaacagatgaagaacctagcgaagcgtcatccgatgaggatgacagtgacgaacgcttcagcgactctgaagagaatgaaccaaggagaaaaaaaccaaaattgcataatttacctgaactaatggctggttattacagtggaaatgacactgaagaggaaagcgatgaagacaacaaaaatgttaagggaaagaagaaaaagagagacacagcagaagaccgtacggccagagagcagatgtcaaacgagccaaagaggaaaaacagacgtgggcaaagggcaagaagaaagatttgggaaaaaaaatacggctcacaagccaagcacgttcaaagggaattggaaaaggaaatggaagatagaaagcagaggcaaatcgagtacgaagcaagagtagctaagcgtgaagctaaagcagcatcattagaggcctctaggagtagggaacgcgaagacagacgtactgaaacgaacaataagaaagaaaaagaaagtgcatccactggagaagaacatccttcttggattgcaaaaagattagctgaagaaaaattacaaaaagctaaatttgaaggtaagaagatcaaatttgattgaacataacgtcttcatctcctaacttcatgtataataaaaactattagcacatctattttatatatgtacgcgtatatcttacatcgtaccgttatagcatttgaattattgagcttttgtatcatctaccactgtcatgctcgccttcacggaacttagtatatgcgaaaaagaattcaggaaaccaaagctggcaaggtgagtatttgtttgtaaagtcgcacctttagcagatcattagctgtagcgcatggaagaaaactaaatgaaattgtttataaaacctgaatatgataaaagaaatctaaataataaatatgattgctatataatagttatatttgaaatgaagagaaagggaagaaaataaaagtattcaaaacgccaacccttaatgaagtaaatatgatttattgtctggacaaagttctgtttttccccattattcgaagacttctccagtaattgggtctctctttttgaaagtcagtaacaaatcatcttttgggaaaattgtagcgaaaaccttgattttttcacttaatggagtcactgtatgatggaaatcagtatatagtgcaaatttacccaacaaagcggcgaaggtaatcatgacatatgtttgacctaagcaaacgtgtggaccacaaccaaaaaccaaccaattcttctttgcttcactagccttagagccttctacccatctttcagggatgaactcatcgggattttcgtaaacttcaggatcatgtaaagctgggtataaggttggaattaacatagcgccttttggtgcggtatagttaggggaaactgggaaattcttcttaacaacatatggaaccattaagacaggaggtctgtaacgcaaagtttcttttatgaccatattggtgtacttcattttctcaatcaaatccaagttcaattcggtagacatgtcattgttacgaacagccaattgttcttctctgatcttagctaagacatctggacggtcagcaacaatttggaacaaccaacaagctaaagaagaagaggcatcttgagaagcaaataagaaagtgaaaacagcttcggagatttccttgttagtaaactctctgtggtagattctagaatcatcatcgttactattctttgcatcgtgcatcaacttacaccaagcatccataacacaaactggcttaccacctgcagcaatatgatccttagccatttgagcacagttttcgaaaatcttcatggccatgtctgcagttttcttaccataccatgttttagtgtaagggataataattgggaagttgactaattccaatgctgctgtaaccaaatagtaatcatcagcaatctttctgacttgatcttcggtaatatagttaccacagaaagagttcaatgataaggcgcaaagaatttctctcatttcatggaaaaagacctggggctcgtagttattctccttagataaacgaacaaacttatccatgtacttatccatgatttgttccaatgaaggtaagtattgagccaaagcttgtttagtgaaaagaccgtttaatgattttctgtaatcagtatgagctttaccgtccaaaaaaacccaattgcaaggtcttaagatcttcacagcaacatcgacaacgcaaggtttgacgaatttggaagattgcaagatctttcttgccaagtctctagtagatgcgataacaacaaatttatggaaaatagaaacacatgaaagtggaccggatgcccacttagccttatattcttcaaactttggatctaaggattccaaaaatggaccgatgatgggccagaacttaaactttggacctgcgatggaacctttcttgatttgatatgcaacttggtcccaaaccaaaagaatacagattaaagtagcaaatattttcaaatatgacatagacttaagtgtatccaggatactgaaggcagtagtgacgcctacagagggctggtctttagccaattggtgtagcgtagaattatgagtggcatgttgtattatattttctgcgacagaactcattttgttaaaaggtatttattgtctattggaatagcaaaatgtgatgttttgtttattgtgatgaaaattaaggaaacaatataacaagaaagaaatgagtaagaataagatatttggaacaatagacaattagcttatatatgatttttttcttccaacaagattccctgcttgcgtatataaaccaatcagtccctttgcctgaagacaataaggacgatcttttacaaccgattcgataaaaaatcttttcaaaaccgaaacatgagctctcttcaatagcgatataaacaccggcagcatatagacgcaggtttgggctatgttttgtcagcagcgataaaaggtacgagacttcgcagacttaaacgagggaaaccttctcgagaactatggtaacaaatattacccgccccggaaattgcggaacaaatacactgtctctttacgagtttctcgtttaaaaaatccaggggtgtggggtgtgggcgcccatatgcgcgaacgagcagctgcttgtgatgttttccggggaacctcccacgttcacaaccgcgccgcggaaataacgaagtttttacgtgtaaagagattacgtcaaaggaaagaagtgttcaatgtgtctatcttataggcgtgatagatgtcatttataacatgagtccacctcatgcataacgtatgtacatatatgtgggcggtagggttttgattaaagtaacataattatccaaggaattcatagttgttctatttttcttgtttttttgtatcatcagcggcaatttcttcgttggagacatcgccagctccaccaacttgtgatttggatgactctgactccttgacaggttctgcttcactaggtgcgttcggttgtgttgcttcatcgcttgtacttgtttttattttgtcagtatccgtcgaagtcaaagcggagattggtaattgactagatcgtggctcctttaatgtttgattatctggtacagtattcccactgtctgcttccttagaccatttggaatgtgatgccgattcagattccactcttggaagggtgattcctgtatggatacttcccacatttgattcagatgattgatttgtgtttgttgtagttggagaaggtgtcaaaggctttgaatctgcaggtgtaatgcctaatgtacttgccgaattcattgtggcgttgcgtggatacgataagggtgaagctatgttgcccatcagttgttgtttcatcggcattgttgccgaaagggtctgtaggttagttatagtatgtccttctagttggttagagttaggcattgtgcattttttcaagggcttttcacccgcagcgattgtacttacagctggtatagaattattgggtataattttgttgttcaaattcattgaggagtatgtcagctgagcagcagatatatttgaaggaccattaggattttgatagttgttaataggttgataataggtacgcggactgatggatttaataccagtgctactgctactactactgctatcattgcttggattattttgtttcaatacgctctgaatatccctgatgaacaagggataaagatagtcagcaattttttctctttgtgctattgctagggcacgctcaaacggtatccagacacccttcaaatgcatggaaccaatcttcaccacatgcctgattttttccgcttttagaataccatctcttctacctcttgtcatcttagttacattcagaagtttggtaccattaaccatatcattatctgctcttcttaccactgaaataccgttagcttctacctgataacatagcgttttttcatcctcccacattgttgttgttactcttggccttattatacttgccgaagtgccgctggtgttactgcctgtggcattggtagtggcgattaagggcatcgggtgccttatggtagttgtttggaaagaattcatggttttagccattgagtcatactgttgatctgacactccgtgcctatttgcagttaaataagtttcttgatcagtagagggtttaactggtggagttatagaatttccatcatacaacgggctcacctgttgttgttgctgaggcggtagcaaacccacttgcggaagattgtagcttaaaggtccattttggctggttggaccttgagttggcgttgttaatgatcttggaggaattggagaatgcgagtttggaattgacgaagtcttgtgaaaaccggggtattggtaggtggaaggttgtggatagtttgacattggaggctgctgagctaaggacgagatactattactattgcgactagtgcgattagaattgggagacatagagccactggacgaatcagaaggtggtccagatttactgaactttgaaaatgcattacctatctttggtggttgggccggatacgtttgagcttgtaattgttgttgctgctggtgttgttgctgttgttcaaaggttgagtaggttttttccaaattggggttttggacttgattactggttacagatggtgttgcaccgttagtggttccatcgccgtttgcaggataataataatacgcttgtggatacgaatatgccattgattgttgggcttgcatttggggaaaataatagtagtatggtacattgttactgatattagtactgttattgctttttttggtggtgattgcagaaccattcggtaacgcagttgcagtagcgttggaaggaacacctacagacgtggaaggtggattggaagcatttgagtcagaaccgctactctgaaaggattcttgaacttgatacatctgaggctgggattgcagttgctgttgagactgggattgcggctgctgataatattgcgggtacggccactgttcaggaactacgtattggtaggatacgggcatcagaggttgaacgctctggccgagatattgttgttgttgctgctgctgttgggtggactggccaatagtactttcgctattgctcacggcactcatatttgattcctggcgcatgcggttggacttgatatcattcgtattgattaggttaccgatgggcatgacaaaaggaccttaccagggttatataaggatgattttgtactgtgcttaacaaatccactttcaatttctgaaaacaaagatcaaaaaggttttttttttttatacaattgtgaagtatgtttaatgaaaacagcacaaaatgatatctctctgcttgcaatataaaaagctatggaaaaggattatcaactatactagaaggcttacacacgcacaggcacacacaactaatgcaaaagatagtggggaaaaacttcaaaaactaacaaaaagaagtgttaaagatgaacttttttcttttgtatcgtcggcttgccacattcgataagttaataaaacacaaacgggcaacacatctacgtactttttatgtgaagacaagagaaagaatacatcactgatacgtgcgtctattgcgcagcactgtactattgcgaagaactgagtgaaggcaaagaatgagatgatcgatgcttagccgactgttaaacttactgagcggtagcctctactagttccttagtcagatcgcactcaacttggaatgttccgtcaggcccacggaagaaaaagcaacaaaagaaagaaaaaccggacaacatgcgggaaaaatgcaaactgtgtgagggaaaaattaactttaaagattacatcaacggcgggaaaagatccttccgcagtccttctactgcggtttccctgcaggcacagctaaccggagggaagacaagtcaagcggacatgcagttcccgctcaggcttctttgcagagaaatcggaatatgaattttttgtgttttttgttaacttctttaccattcgcatcacgggaagagtgtgttggcataagaggcgcaagaaaaaggtgacccacggtggtgggaaagagaagaaaaagccgtttgcggaaagcaatgttttgcccattcagaaacaatatctttgctgtatccctacatgtattatgccgcgttgcttgtgcaggtacggagtccctgcacgatttttcaacaaggtctagatttgctaagacgatgaggcggagcccgaaacaaacaagccaaaaaccggaatttcgcgcttggtgtgctttcgcatcttttcgtgtggtgaatgcacctggtgcacgctgcgaaggtgacgtagcaatccaaaaaagggaagtctaggcgctttcaaccgccccccaccgtgcatgcggattggttgtcacaattcgcagacatattggcaatgtttcctcccctcctgttgatgcgggtaaggggtgtctgttatgcaggaacaggaaggtaaaaattaaatgggccttaattctgtagacactctcttggggtaataaggttaaaagccattgttgaagtacggaatcatctcttcattttttcagcgcttgtaaggaattaatccccaggaaggtgccgatgtaatgagagaagtattcttgttgtatctctttggttcggagtatttccttctttcttttctttgtagtttttatgcaaatgcagggaacagagtacccggttaaggctgttagtcagccgcactctacacaaaattacttggcaaacacgttggttgggaaaagctttatacttggcggtgtagtaattgtaaaggatcaagattgtgtcatgctaatgtgccgctgtgtaacaacctttttgaagcgcgtatttaccaccggcaaaaggccattgtgtcacataaaaaaaaactcccgccaaagccaggttcattttgcataagattcaccacagtacggaaaatacgataagttaaccagtaatttgctcgctttagctactgataaaccttctctgttaacactattatttttttattactttagatttttccgtttgtgaatagccatttttagatatataatggggttcagaaaaatacttgctagcaaatcgcatcacagtcgccaccataatcagcaccataagaacctgaagttgcaaaatcatcgctatgtacttatttccaatattacaggatcccatgaaacaaaatatttatcacccttcaggatggacaattgttcaggaagcagaagacgtgataggctacatgtgaagcttaaatccttgaggaataaaatccacaaacaacttcacccaaactgtcggttcgatgacgccactaagactagtgatgataaatgcgtctcttatgaggtgcccgaaagggatggccttgctactatttcgttagaagaggtttttccaaagtccaacaggtgccaaatacctgaagaaaacttgggagaaacagatagcgttattcacagagatttgggaaattttgcaaatgagaatgactatccacagtggagaaaagttgaaagtcaatataacttagagaatgtccagcctgaggaggatgaaatagttgatagactcaggtccgagattagaagcactaaattaaaatctgtaaaaacgacaagcagaacacttgaaaaagctatagaggctcgatgtactggaaagagagttcttcaacaactaagttgtcagagcaaccaactcaccaagatcgagagcaattgtgacatgcttaaaattcaatctaacgtagccgaccgaaagattgacgaacttgcccatgaaaatagaagcctgcttgcattaaaatcacccaaccccttcaggaagaaaagggagagagaaaagcgagaccagatctacaatttgaagttaaagcatcgtcacttacagcaagaaactatgaaaagagcccaagattctgacaaaaatttagccataaatctaagttctgaatatggacggtatggccaaggggtggaaagacagcgtattcttagagatgcccagaagtatcagtttgaagccgatgaagaagataaccaaatggaaatcgacttgtacggaaacctagaacaaataaaagcggtgagtggtgacttgaaaattatggctcacgcttttggcagagagtttgaagcacaaaacactagaatgtttgacatcgagaacaatgtacagcaggcagataatgctttacaggccaagcgatatagattggagaaagtgatcgggaaaagatggtgatctgttatacacacaaaatatcgtgtataaatatattgaataaatagtttctaaaaaggcatacgcagatattcttgcgaaagagaaaaaaaaaagagcgagggggacattagtactgaaggtctcaattcttctttgtattttctttcggagttgtcagacaaagctttctctttcccataaataaagtgcattcaaacatcggcaggtttgtttttcccagttgttacgtatttgtttcccgttccattcatgatcttaaactgggttaactgaaaaatcaacatgattttgtgaaaagtaaaagagggtaagaaagatagataccgctgtcgtgggactatattttttacagtaccaagtctacttgcttctcataaagttgataagttataattcatataatttcatttgtcaaaaaagattttagttacaaaacgatatcaaagttcaatcttgttgggaaaaaggaaaacattatgaagggtttccggtaatcactgcgtatgccacactattcctatagaattgtcttgattgggtgcttatgctgcggaaaaattatattctgcgcttgccttttatattaagcgtcacaacgcccttaccaagatcgagcggattaagacaagaatgtatctcaagcgtccgtatatgtttaagttgaaaaggatatttagtaagaataattctaccctacaaacgatattagtaaaaaaaaaaatcaataatagagttattgtacaaacatgttctgaaaattggaagcatcacatcgtatgctactagagaaaatttttactatccttttttccacaagcccagccctagcccgatcatcctattaattgtcagaccaccgaatgctatcccgccacggttgatataacgaaactctttactgctttgggtcaaatatgcctcttttccgcattttttcggagtagttcattgccgcatacataccgcaacttggacgaggatgtcctccttctcttacttttttattcgtttccaatttgtttctcgtaccgttcaagtttcaagcctacaagaaatgtacacgacatggatgcgtcagcctgattcagatatgacaagattgttcctgcgcatatgtgaatatgagcgcacgcaatacattgagatcttatttgggtttgtaagtgcaaacttaatttactttgcttcctgccggttttgatgtgcacctgggaacttaaatagccgccaaaagaaaagcaatcagagcggcgcggcgcagacaaaacccgaagagtttcctgggaacggtagaggccttggtagtaccttactaacgccggagaggatgattgatacgcattgaaatcgtacagaaaacttggggcaaagcgctcttaccccaatattctcacccaaacagtggcaataaataaagaaaaggtcatcactttttttcgtactcttatccgttttattttattttattctttttttttgagtggagaatcattaagaataaagggtaccttttgtaagcacgatgaacgaagttacttgttccataactggtgacaacccaattcataagatcaacaatggattaggcttgaaatggaataatctgggtaaattctctgattttcagactaacgatagcgccgcgcgagatgctagaacaatagattacatctttaccaattgtcaaaccggcagcagtattggtaagatagattttcgggccgcactaccggcagataaatctcaacatagtggtgtcagcgaaaaagaattttcaagacttgagaaccagtggtcaaaggaattctcttgtttccccaagaataaaaatgctgatgtgaccaagcccagtagaaacaaacatgagaaacgctccgctaatttgcacaataggtactttgcacaatattatagtacggcatatcagcaaaatcgtatatatccttgtcgaatatcttacaatgaacactcatctgtttctaatggctgggaatttcagttcaaatcaatcgaaaatcagttactaaatgagctaaagatagaaaacaatgtagaagaaaaaactgttggttatgaatatgtggcagaatacgaagaaacaattgatttcatgcatatgctgtcatccgtaccacaaacatatcaattcctaaaatcaaacatctacataacggaacgggacccatataaaataggatgtgtactaatggacaacggttccaatttgaacgaagtagtaatggcctttgaagcagccatttcacaagatccaagccatataaatgcatggttgaagttaggtatagttaattttgaaaatgaaagcgaaagcaatggagagcttgctttgcgaaattgcttaaatttggatccaaataatacaattgcattggaaaacttagcaattcaccatataaatcaacaaaatgaatcagagtcattgaaactttttcacaaatggattctttcaaaattttcgaaggttttccaaccttctgcgggggaaaacaaagatagcattaataaaattccgaaaaaggcccatttggcgcatattctagaatccctgttgaatatgggtatagaaaaaaaagatcagtatgatatatattcagtattatcaatcttatattattcggatcagaaaataaagcaatctcagaaatgcttagagtttttactactggaaaagcccaataatggaacaatatggaatagatatggtgctattttggccaatactaagtcgtatcactctgcgataaatgcgtacaataaatgcaaacaactaagaccgaattttacaagggttcgttataatttagcgatcgcctacatgaataagggtgactatgtaaaagcaagcaaaatgctaatcgaagttatactgttacgaagtaaaggatatgaacacaacaaagcaaaaatgcaaaacaaatttatgcaaaatttaaaaaatgctctcatcgcttcaaaaaattttgattcacttgatctaataaatggttctcataatacagaatcgttaatatcaaccttaaaagctatttataacaaaatggattaggttttagttaatttttttgctatatagtgcattcaaaataaaaaaaattaaagctgaaacaaaccaaatatgctattggacgttcgaaaagctaattgcgtaaaggaacactaaacacagcaagcttatgctagttcttctcaaaaatataagttcctcttgcaagaatatgaaggtaatttcactttatcgcgcaagtgcatatttctgagtttactatgtgcttcgtctgaaacctctcattatctacttaatatcggctattcatctcacgtattcacgtaatatttgatttttgtactactatttctctctgtcatacgtgcatgatacatttccttgttcaaattaaaagagtcaccgtcagcctctcaaaacaaagaaaaaagatacccggctgaacatgagtatcaatcatgaaatatattatatacttgtatttgagcatcgttcagtagcaatcaagctcatcatcgtagtgattgttctccttcagttttttttagcacgaagtcggcaaattgataggacatgggcccatactaatagaaaggaacggttcagagaaatgacagctatcgggaatactgatgatgcacttgatactagtacagccgcaagtaaagaaaatggaaaaggtagactcagggttcaaaaagcttgtgaactttgcaagaagagaaaggttaaatgcgacggtaacaatccttgtctgaactgctctaaacatcaaaaagaatgccgttatgatttcaaagctacaaaccgtaaaagaagaagacgacaggtcgcatcagctgttcgggacgttagtaagacatatgcagaaaccagtgagtcttttcctagggacttgttaagtaaatcaaatattatcataaatgccccctcagatggtgtatcttcgtctgctagcaactctcccaatccaaattcacattatcatcatatatcatccactttacccttcatgagcggtaggccaaaccatacattccattccggaagcaacttaaatggagaaaataacaataacagttttccggaggatcacatggctaaattacttctgcaattgagttcaaaattggggaatacgaccaaggaatcgtcaattagaacaactagaaccaatgctagtgatgtgaatgcaaacccgacagtggtcaacatgaaaaatagtcaggaagactgtgacacgaatcacaggtctgcaatatgtgactctgcagaggctcttcataataacaacatcaattctaaagagaataagataatcaactctcaaataactaacactgttaatgatcactttgaatcaccctggcagacattttctttagataagtataggtttcaccgacgctaccaaaatattctgccctattaccttggtgtatctattttaaaggatctatctccgcagacaatagagtacgcgaagttgaaaaggccaagagttcaaaactatggttggaacttgtcaggaggccattacttaaagtataagggtgactttagaagccaagaaaaaaatataaggcatgagtctaaatttttcgactttgatgaccctgttcacttatccttaatcaataagttactaaggtattattttgatgagatcaatcctgttttcagtatcattcacgaagcgacattttggcagcaatataacaataaatttctacggcaaggtaaacaaaataattcatctgcgaatctattcacttccatgctttatctaattttgtctactacactaagattcagagaagggcatctagatggtcagaaagggcaaggaacctacagtaacacatccttaaatatcacattcgaggaaaaatctattttgatcaaaaaaccctccatagaggaaaatttattcaaatacgcttatttaataatcaacacgctgacctttgagtgggaatcattcgaactaatacaatcgtggcttttgataaccttctatttcagaacctgttacagacagacggcgtgctggaacgcgttaagtcaagcggtgaacatgtgtaatgggatgagtctatatttaaacaaatttcctgagatccattccacttatgatgaatcaaaagcatggcattgtttctggtgttgttttataatggataagttgataagttttcaaatgggtcgattctaccaactatcattacccgcgagcgagatgtgcgaacagatgaatctagtgaagtcaaagaaatttttacaagaagaagatgattggtttcacgaagagacttttcaaatgcttgatttgtccataatagtgacacagtttttaaaaagagacgcacaggatttaaatttgaacgagaccgtgcaattgcgcagccaacttggtcaatggtatgacacctttatagttggaagtcaaaccaatgcgtacgacgacaattatcgttacttctatcaagttcaaccattcatgacatacctggatataaggctgactttcgaagtaagacaattattttgtctaatcgccccctcatctaccgcaaataataaatccctagaatatgtcgtcgatactgaattgttaatttctcattgtcaaatggctattgaaaatttggctgaaattacgagaagtaatcttttctttgttccgtggtggttaaacctttctcaactattcacggtaaatttaatatgtattatctacctgcacgcagggattgccgtaactcaaaataaagctatcatgcaaagctgccaagaaatatggcgaaccttagagtgctctaagccaaaaaatcggccttcaatgcttcctgagtgcttgtggtgtttgaaaatgctgaatcatatgttctgcatacgactgagagattctgctttgcaattggaagctactctcggaactgatcatggtgatgacacccctaatagaaataagtttgagcagttcaagaaagttggcgataatgatgcggatgttgaagttgatgctggtgaaagagaagaaaatgctgatgaaagacaagaaaatccacataacaatagcaaaagagtaccattagctactaggtctcataataccactaacttcgacggttcaatcgcaatttctccggaaagtgcagtagcaaatctaggtactgatactggattgccctcagatgttcttgatactgtcagtaaaatagggaactctcctaatgtgtttgatgatgatttattttccaatttattatggtttgaccaaaattttgcataaggattctttttctattccataaaaccattttatggacacgtttacctacatattattatattgtatataagatgttgaaaaaattgagtcaacctcaccttaccacatgttggtccgttgctatgacaaactctcgttttacaagaaggaggctcaaatttcgggtcacccacccatatacggatgtcacgctatgagatcttttaaacaatagacaatttttggtatcctaaagatataaaagaggagtttttttaaaccatggtaactattttcaaatttgctctgctgcagttttttatttctgtttttctttttttgttcccaacaagaagtgagttaataaaggcaaaaacagtggtcgtgtgagaatgaatacagtttcaccagccaaaaaaaaggttattataattggtgccggtattgctgggcttaaagctgcatctacgctacaccaaaacggtattcaagattgtcttgttcttgaggccagagatcgggtcggtggtaggttgcaaactgtcacaggctatcaaggtcggaaatatgatataggtgctagctggcaccatgatacgttgacaaaccctttatttttggaagaggctcaactgagtttgaatgatgggagaacgaggtttgtttttgatgacgataattttatttatatcgacgaagaacgtggaagggtagaccatgacaaggaactgcttcttgaaattgtggacaatgaaatgagcaaattcgcagagttagaattccatcaacacttaggagtttcagattgctccttttttcaattagtaatgaaatacttactacaaagacgccaatttctcacaaatgaccaaataagatatttgccacaactctgtcgatatctggaattgtggcacggcttagattggaagcttttgagtgccaaggatacatacttcggtcaccaaggaaggaacgcctttgctttgaactatgattctgtggttcaaagaattgctcaaagctttcctcaaaattggttaaagctaagttgtgaagtgaaatcaattacacgagaaccttcaaaaaatgtgacagtgaactgtgaagatggtactgtgtacaatgctgattatgttattattacagtacctcaaagtgtattgaatttgtctgtacaacctgaaaaaaatttacggggaagaatagaatttcaaccacccttgaaaccagtgattcaagatgcttttgacaagatccattttggagcgctaggtaaagtaatttttgagtttgaagaatgttgttggtcgaacgaaagttcaaaaattgtaactttggctaactctaccaatgaatttgtcgaaatagtacgtaatgcggaaaatttagatgaattagactctatgctagaaagggaagattctcaaaagcatacgagtgttacttgttggagccagcctttatttttcgtaaatttgtcaaaaagcacaggagtagcaagctttatgatgttgatgcaggcaccgcttacaaatcacatagaatccattagagaagataaagagcgtctttttagttttttccaacctgtgctgaacaagattatgaagtgtctagattctgaggatgtcatcgacggaatgaggccgatagaaaacattgcaaacgctaataaaccagtcttaagaaacatcatcgttagcaactggacacgcgatccttactcacgcggtgcttattcggcctgttttccaggagatgatccagttgatatggttgttgcaatgtctaatggtcaagactcccgcataagatttgcaggcgaacatactatcatggacggcgccggctgtgcctatggtgcttgggaaagcggaagacgggaggcgactcgaatctctgacttactgaaatagaatctattttttcgaaattacttacacttttgacggctagaaaaggatatacatacatattaaaatttttagtaacactctgtgctttttcaaaaatttgaggtacacctaattctcccacttgttgcttataccaagtttgaacaattttaatgttaagcacaatagattggaatattatcatatggtggttcagagagtagtagggtgcattttcattcctgttgcctcaatgtgttttctatctgtatttacgtgattttatgaagtggtggcatcgcttagatgtggtgcataattagagactaatttttgaaaccacgcatgaatgtcaagtaattctaactgagcatctgtcatcaatggcacttgcaacttcaaaaaatcccaccaatattttgacggcaccaatttacctttgaattttatttgagttttccttgttaatcttgcattcagaattccatagaaaaagaatttttcaaatggaattatatttgtagagtgagaaaaacatccatcacaagtgcagttatccggaggacatatgcattccttgtcagtgcatttacaatcatccaaataatccatcatcttatcagtaatttgagcttcaccaatattggttaaaggaacaccactttgttgaatataagaattcagttcctcttcgcttctatggattagacaattaacacatgggcagctttcatcttcacaagagcactgcgtgcttaaaaaaatgcccttatgagtcaggacttcaactttcgaagcaacgtcgcttgaatgaggagcagcaatcgttgttgtactttgtggggtgagtgtttctgaactgtcatgcgcaccaggaacagaactattgtagttttcttgtaaaatatcgttaaaagcggacgtagattccaaggagccgtatggcgtaaatatgtcatcagacggtgccttgttcgtcttgccattagaagctgggttctgtgatttatctttcttacagcagtttgaaaaatgtcgtataggctcctgttgaagccggcttcgctctttcttctcacttgaagaagatgacttggtagagtccggagatattgttcctgttgccggagctttgggagagtgtttcctaagaaactccgtttcggtgatatatttgttaccatcatcggtaaatgtgctaatatctttaggctcatgagcagtgaaaccttcctccattaatatatgcaattttccgtttatcattcttgcctttctaacagcagaggcacgtacaaacagtattggctgttgattcattgcgctgcagcagtcaccttcaatttgtgcaccattttcgtattctgtactttgcgatgtagagtctactaaaatagcgtctctgatagccatgggtgaaggtcttcctctagttctcaccttaattagcattcggtgagaatgcctgcatgttgaagagcgatgccctctgatgcacgatgcacacgcatatttgttcccattaaatattatcatctctgatagagcttgaagaacttaccagactgtttcaagtttaaaacaaggcgcctcatcgcatctacctcacgaagatgcagcagcttattgtctcgagatccttcttataactccttttcgccattacccgaaaacgagattacagcctctaaaccaagagctcgaaaagcgccaaagtaaactctggcgtttagcgtacgaaggagattatcctaaaaggaacttccctagtaatagtgtaatttggaagggcatagcatgtcgaaaaccgctcagaaacgtctcctcaaggagcttcaacagttaattaaagattctccacctggtatagtggctggtcccaaatcggagaataacatattcatttgggactgcctaattcaagggcctccagatacgccatacgctgatggtgtttttaatgctaagctagagtttcctaaagactatccgttatctccacctaaacttactttcacacccagcatactacatccaaatatttatccaaatggggaagtgtgcatatccattctacactcccctggtgatgatcctaacatgtacgaattagcggaagaaagatggtcgccagtgcaaagtgtagaaaaaattctattaagtgttatgagcatgttgagtgagcccaatatcgaaagtggtgccaacattgatgcttgcatcttgtggagagataatagacctgaatttgagagacaggtaaagttatccattttgaaatcattaggattctgaaagcaggtagcaggttaatgatcatttggtcttccttttaactgttctctatatacataaataagcatatctaccatctaaaagaaagcaaatgtcacataataaatatgttaaaatctcaatgtcttcctggcttttcaggaattcaaaccatttccatttcgttggtgtataatcaggggcccctctactctcacctctctgtaccgaagcgttaatcaattttcttttatttatatacacgatgattgtaactaggttattttcctatacaaaatttgctgaacactgaatctaagatttcctcaataccaatagcttgtcctgttatcttagctattccatcggatgcatacctcaaattttctgtggccaatactatatcattatggaaatctttggatttgaaaaactcttccaagccgtacagtacgtcgtttttgagaatctctgacactcttttggaaacaatgacaggacttgcatcggcacttgattgagacaagctttcaaaattacttgtcaaagtgctaattaacgattctattccctccttggtcttacaggacacgcttaatatggggtactttgatccgagtctagtttgtaatttgttcaaaactttcgtcatctcatcatcggaaactaagtcgctcttattgactacaataattattctcttatttccaaacgtcttcgatgatagatgtgctaatatgtcctcaggcaaaagttttgataaatcagtaggatctacaatgaataaacataagtcgctctgtacacttttcttctttgctctatctatacccagcatttctatcttgtcagaactcttttctcttatacctgccgtatcacagataataaccttatagccattcacgtttatcattgcatcaatagaatccctagtagtgccaggtatatcactgacaattgatatatcatcgttagtcaagctgttaactaatgatgacttaccgacattgggagcaccaagtaataccagctttattccattttgcagtatggtagacttttcgactttttgcatgaaagtaacgatttggtctcgcagacatatgatgttcttttctacattatggaaaatctcatccgtattctgaatttcttggctattatcgtcggcaaaatctattatagcagtcaactgtgccatattctcgataatggtttccctccagttctcaaataggattttgttatccccattgaaacttgacaaggcagatctcctttgagattctgtttccgaatcaataagatctttgataccttcaagttgggtaaggtcaaactttccattttgaaacgccctcctggagaagtcgccaggcaaggcaaatcttatatctttaccactgcttctatcgtgtaacgagccgatagctttcagtatactattaactacggctttcccgccgtgaacgtgcagctctaacacatcctcaccagtaaatgaataaggagcttggaaatatagcaacaacgatgtgtctaataatattttactttccttttgatcatgaggtttcacactacaagaggacggcgaataaatgttcctcaaaatagccttcctgatcggcagaactgtacttgaatcaactagtcgattgtaaatgtacttagcatgggtaccagatattcttatgattgctatcgcagaggtttgatttgctggtgtagataatgcatatatggttggttgctggaaggtataaggctttgcaagtccggagtacctctttaacgaccttcttacgagaaaggatctcgaaataagccgtgattgtaagaaagatgcactattcataaatagaatacttattaaccatatataacattctctaagtagatagcagtcgtatggaatattgctgtatcttcatgtaacctcgtaaaagacgttatatatgggttagttagccaaaaaaataaaaaatggacgagtccggaatcgaaccggagacctctcccatgctaagggagcgcgctaccgactacgccacacgcccgatttgtattgaagactttgaagaagtatagaaaacataaatgtaggatacatttttaaacttttattaatgaaaccaatttgaagacatgtggcaacccgtgttactcatatatatatatatatatatatacaactatcagaagattatcaatctaatagatctttaacgccgcctcagtactttctgaactgcaagtagaatatttttttctggaatcggcacattcacattcagacgtatacgatgtcagcacttagattgctactatagcaactcatttattattaatccccattcgttccgatatggatggcatattattacctttaagaaaggtggagttccaaagattcatcaattttactgtttatagaaaacgttacggaaagatgaaaagtaaacaccaaggtctcttatgccttgacataaagaatacggaatagaatgattgtagacgcaacaagatgaataattaatggcaaattattatcctattagatataaattacagtcgctttaatgcgtgattatagaaaaggtccttacaatatgcagccgggtaaagagtgaagtttcccgcctctgaaaaagagcaatactaaaataatctgaaaagaattggtgaaaagaaagctgtagttatatatacagaatgggcatagttttgaaaagagcaatagcagcaggtatgaaaccttttccaaacagtacgtggcattggagccgaaccataagacctttctcacagcatttgtctagcacatgctttctgcagcaatcctcgagatttacttcaaaacgatacctacacctttcaacattaacacaacaagaaaagcgcttcctacccgaatctgaacttgctaaatataaggaatactaccagggtttgaagagcactgtaaatgaaatacctgaatcagtggcctctaagtcaccttcgttaagaacgcttcataagagattacaattacctaatgagttgacctattcaacactttccagatgcttaacgtgtccctctgcaaaactacccgacaagataaataatcctacaaaaggtgcagctttcgttaatactgtacctactaataaatacttggacaaccacggtttaaacatcatgggaaagaacttgctctcttaccacgttacaaaatccattatacagaaatatccgagactacccactgtggttttgaatgctgcggttaacgcatatatatcagaggcggtactggcgcacattgctaaatactggggtattgaagtagaaactacgtctgttttatcacgctatttgaaaatggaaccattcgaattcactttgggaagactcaaattctttaataattcattgaactctaaggacggtattgagctaatcaccggaaagaacttttcagaaacaagcgctcttgcaatgagcgtgaggagtataatagctgccatctgggcagtaacggagcaaaaagattctcaagctgtttacagatttattgatgatcatataatgagcaggaaattggatatcacgaaaatgttccagtttgaacaacctacaagagaattggctatgctatgtcgtagagaggggctggagaaacctgtatcgaaactggtcgctgagtctggtagactatcgaaatcacctgtctttattgtgcatgtattttcaggcgaagagacattaggtgaaggttatggttcctcattaaaggaggcaaaagcaagagccgctactgatgctttgatgaaatggtattgctacgagcctcttgctcaacaggaaccagttattgatcctggcactgttgttgtttagttctgtgtttgccattttgtagatagagaactccttaaccagaatacattcttgtacatatatatatacacgttggtacgatatgcgtttactttatgtgtactaaaatatataaaagtgaacagaagcatgttccttgtttactactatatcttaccaggaaacagacaaaaaaaaaagacttgctatatttaaagagaacgcacatttgtgaggggataataacacaaagcaaagtaatatagggtaaatggacctcctaaaattcagttctctagctatatcagaaattaacttcctgcacgagtcatcgtttgactcgatagaccactcttggtttttattgataggttgcaaattggatcaagatgatgaaatttacatcccaataaatggtaatgaagcagagtctcaatggtatattgaaaaagttatacgaatcccgatgcaggaaaatgataaaataaatcaagaacgcctagaaaggagaattaacctaacaaaagtgactcaaaaggacatttgtatactgggtattcttgatttatgtcagttagaagaggacgaaaatatcactaataaagtgacggagaaagtgctcacccaattgaccgccttggcattgaaatatctgataaaatataacgtgtttcgccaacatacctccttccaagaagctgtcaatagtttaaagggttataaaattgaaaatagtgtacagataggcgcggaaattatccttgattttctacaagataaagtgcaaattaaggatgtaaatgacagataccaaattcccacacctaataataccgtagacccaggttttgatgagtttcaattaattgacatgaaggataaagaaatcaatattcaaaaatataataataataccataagaaaattactcgagaagattaatcgaatgataatattcttgaaaaattatgatgccactgacaagcctttctcttccacgcaagatgtaatacttcgaaaaatatcaatgcttgtaacacaactgcaaagaggtggaacaagtgacatgaattacctgctggataacaaaattaatgaaataaaattattagaaatttcgtgtaaacaatgggaaatttcaaatatgttaaaaaaataactagaatatatatattacacagaattattttcttcacttcctccgtcatcagattagtagcttcctaatacctgtcacaacttcccatttattcgtgtgtttgttgtatgtacaacccagcagctttttattggtaacgggacaatggccttcattattaaccaaatagcttatggcacacgggtagcatgccacgtatcctgtttccaatacacaggggttttgtacagttttttcgcaaacgggacaggcctcagaaactccctctttatcttccgttttgtcactatgtgaggagaaaggcggccttggaatatcttcatccaagtcattgacccttttctgcaatttagtagtcatgtcttgtgtggtccaccattggtacactcttaggacaaatataaaagtggggaagaattgcgaacccataaatgttaaaaatctgggtataatcgataattgtccttgcattagcgcgaaaattgacgatatatttgttttccttagcctattatccatccctttcgtctctttgagaccagagagttctgacgatagtggtcttaccgttgtgtactctatcttgaataagtattgcaacaaggaaaccgaccctgttcttttagttaaaaataataatttaacgagtaaattggataacgctaataatttcttaataaatggataaattcttagaaacgctctcttgggccatttattttcagtttcatcgctgctgaatatattattcattgatattttctctaatatttcatccaacttcgctgtgatataggggagaataattttttccaaaaaaataacactcttttgctgttgattcagctgcaaaccttggggccattcactctggccctttggatttaaacattgtgttaaggcaagatttctgtccctcgaactaaatagttgcaatccataaaaccgatcaataaacgtagaattgtatgtctttagatgataccattcaacaaacccttttatcgcttgaaaccactcaaaaaagtacttgttcagccgcaaagtatacctgttagggaagttcgccactaaatgatttgccagtagataacggatggatgcgggcagtaacgaatcgatttcttgtgatgacattatctcaaagatagtcggatacaatggttctaatcccaccccatttcgaccgcttgttgaagaccctcgactagattgtcctgcagacggtaggtttgaataaaagctcatcacttgacgactaccttcctttcctttgctttattttccctgcttattcccttgcttcttctggagccttcatgcaaaaccgtttctctacctaatgtgattctgcggtaagcattgctcttaagcatctgaatgagacgaaaggatgactccacactaaattgtacctctcttctccagtgactgaattggaggttaccattgccagtgacggtaatcgtccacatcgatgatttcttagtataacccacacacctctcagacatagaggccccaggtgcaacgtgatagtataactgcccggaagtagaaatacaactattcccttcatattaaaagaataaaacttcatttgaactctttaaaatttagtggttcattgtggtccttgtgtaaacggaaaaaaaggatattacggtagtgggtagtacataacaagagatgactatccctggaagatttatgacaaatgataagggcacttttggtgaatacactgctagcacccgttggcccattatcattcagaatgctatagacgatttaagtaagcatcaagaaacggagaagagtaacggcactaagttcgaacaaggtgaagttatcaaaaaggagctcaaggaattccgtcaggagataattgatcgtgtacctttgagaccctttactgaagaagagatcaaaattgccaacgtcccgctttcgttcaatgaatatctaaagaaacaccctgaagtcaattggggggctgtagagtggctgttctcggaggtttacttgtatagaagagtaaatgttcttttccaacgccaatgcgaatgggctaaatttgacatattcaacagacttaaacagtcaacttttgagtcctcgttttatggtgtcgtggaattggcgttaaggtatgaaaatctgttaccacagctgagagaaatgaagcaaaatccaggaaatgagattgacgatatattgaaagttctttttaaagagtttattgagatttctttgtggggcaatgccactgatttatctttattgaccaacgctacgttagaagacattaaatcaatccaaggggcgaaagcaagagctgcatccgagtccaagattgttgttaatgacacggagaaagcatgggaggtattaaccaaagccagggccgatgccaatagcagagaaattcgtgttgattttgtattagacaattctggctttgaattgtatgctgacttgatgttggcagcttttctgttacaaagtggtttggctaccaaatgtattttccacgctaaagacattccatacatggttagcgatgttatgttaaaagattttgatatattagttcatgacctgagagatcgtgagttcttcccaagtggtgaaccctcgacaaaggaatccagagctcttgatttatttgctggtgaaatggaaaagttcgtctctagcggtaagatagaattccgcgaagattctttctggaccacggaattagattattggaatttggacgcaaacgaaaccaaataccatggatccattttgcacaaagatttgcaaaaatccaatttggttatttttaagggtgatctaaactatagaaaattaactggcgacagaaaatggccccgcaccactaaatgggaaacggctatcggacctcttgctacgaatggtattacatcattgagcttgagaacctgtaaagccgatgtacaagttgctttacctgaaggtctagacgcgaaattaagtcaagaatgggaaaaggaaaatcctggccgtggttcttggtggtgttgtagcggtaaatgggcagtcatttgtttctgctctggtatacataaataagaatatgataagttctctatataactttactttatgactttccctatgaaatgttccaaaaaagcacatagatttttagtacgtgccttttattttatgtacttctgataaaaaaaagaaagctcctaaggacaaattacaatcaatggcgaaagaagaggaagaaagtaataacgaggagagatcataaacatggcgtcagtaacagaacaattcaacgatattattagcttatactcaacaaaattggaacacacatctttgaggcaagattcaccagagtaccagggattattactttccacgatcaagaaattattaaacttaaaaacagcaatttttgacaggttggcattgttcagtactaatgagaccattgatgatgtgtctactgcttccatcaaatttctagcagttgattactatttaggattattgatatcaagacgacagtcgaatgattcggatgttgctcaaaggcagtctatgaaattgatttacctgaaaaaaagcgttgaatctttcattaatttcctgacactattgcaggattataagcttctagatcctttggttggtgaaaaactaggtaacttcaaggatcgttataaccctcagcttagcgaattgtacgcgcaaccaaaaaataacaaagatttatctggagcacagttgaagagaaaagaaaagattgagctattccagcgcaataaagaaattagcacaaaactgcactgcttggagttggaattaaaaaacaacgacgaggaccacgaccatgatgaattactaagagaactatatttgatgaggttacatcactttagtcttgatacgattaacaacattgaacagaatttatttgaatgtgaaatgctctctaatttcctcaaaaattccgtacatgaagtcaaatcatcaggtactcagatacgaaaagaatcgaatgatgatgattccactggttttaccgataaattagagaatataaataagccattgatagacaaaaaaggtcaagtcttgaggaacttcacgcttgtcgacaaaaggcaacaactgcaacaaaaagtgcgaggatatggtcaatatggaccaacaatgtcggtggaggaatttttagataaagagtttgaagaaggtcgcgttcttcaaggtggcgaagaaccagagcaagcaccagatgaagaaaacatggactggcaagatagagaaacctataaagctcgtgagtgggacgagttcaaggaaagtcatgctaagggaagcggaaataccatgaatagaggatagaaaaaaatacctatatacgtacacataagtatctattagacagattcatatattatttttttttctgcctacatcagttatattttaatcttgtgcaaaaggacttcgttatttttattcacggtgattaacaccggcgtagaatctacaatcagatttgaagaaaataccacaggctcttttctttccgagaagttgatgtctgctacgacaaattcgtcgatggatggttttaggttttctaaattcctaaactcaaagtctccattactatatgatacggtgattatgctgtcgttcaaatcgagttgtattggtagtgttgacgatggagtcaattgttccttcagtacaacttttttcttatcaaaagaataaaccaataatctctcattgcttagctgaatcagtagcttagaagtttttctatccaaaaataaatggtaaccttcttcttctggcttacccgataatattgtatcaatcttcaaatcaattttttgtagaagcttaccctcgaaatcatatatggtaagctggtatggatttgaagacagtaatattaaggatttttctgttatacccaatatacaatccagaatgtttgtggaatcattactatcatcgtcatcattatcatgtgttatttcatatgtttcttttatgttaattgggacatcctcaggagcctctatattgtccaattcccagattctaatttgagatttattcttactagctatcaacaaccatttatttttgaagtctatattaatgatatcactagacgaaaacggctgttctgagtcttgtaataggtccacatctgagatcaaagatgcgctagaaatagagaacaatttcaaatggaaactcttttcaataacaaggagtttggacgtcgaaacccagaaaaatttcataatgtcgctatcttgccctaaagatattttctttaagagtttggaattcaagtttgcgtccacttggtgtatttctaacgatttggtgtctgcatcataaagtgccatacagtccccgtaggagctgataatgtcgactttcgacaattccgagtgtatcttggatattgtttcattattttcacgcttgttggctgtgctaaacaaagatttcactttggttggtgatggtgactctgaaggaccttgctttggattgggtttggtgtccaagagggcattatttaaaatatccatcccatttgtcttcgcactgccctcttccttgggagtattcacgttcagtttctctaaatcgtgcaattcagaacccgcttctctgctatttaatgactctaactgattgaccgtgttagggcctttcaacaaataaattatttccttcacattttcttgaacagctagcttagactgcagtaatgaatcaggcacatgtttttcttccttttcaccttcaggagaaacagctttcgattgtatttgattcaattgatgcttcaaatctctattttcgccctctagttctgcaattcttgctttcatttccgacctttctagctcccaggtgattctatctctttcattcttcgtgaactccgtttgcaagtagtgcattacaccaggtaacgtgtaatgcggatgaacatgtgcctggttaatagccatattgttttccggtctaactacacgcacttacttcttttgggtttctttattaatgttgttgcttgctcctcacatttagtcgttctaggtggcttttatctaagattacgcgacggggaagatcgcaaagttaagaccaatagagtactataccatatcccaacaaagaagcctaggggatggtgcagcagtaaaaactgaatagactataatagatcatcctacgtaaaacccgaataggttatctcttaaaccttgttttcctgtaaagttgtcccgcgcatgtgaagacgcagagagtggagatcaatcttaaaacaactgaagcaactagcactttcttgacatttaataaggaactattatcgcgtaaaccaaaagaaacgcatgtaaaacatctgcaagttactccatcatctgacacctagagacgtacgtatcagaacgatttgagtggaggggtacaaaaagggactctgtagatcaaaaactgtaatattatccttttttttactttctgagaagctattcgaaaacaaggagatagaactacaagcagttatgaaggacctaaatccagaaatggggaaatttgctaccactaaaggccctcctcaagacaatagaggcatggttgatatagcgacactgcctaattttcctgccaaccgtagtgggactcctcgtgaggagatgtatctggcgcccaacaagatggaaactccaaggatacttaatatgaatatggtaccggattatttgcaaaaagagaacttctcgccagatttttcttctgctaccgtatctgccaagtcatctcctgtcaacgttactcatgatgagtcgcttcctctgggaactattgaatcgaatagcacaaaggattctaaatatgcagttcaacggcaacagcaacaagtggtagatttcatagagaataatatgcagctactgtcttcagaaacactaaattttagatcagacattatgaaaactttggagcttcccattcccaagagaagagatattaagggaaaccatctatctaaactattatttgctaaatcacctctaactatcaacacatattgccaattttatgaccgtagaaccaagcgaatttgcaatcaagaaatgatatggaaagataagaacagtagagagaagcatggttctagaaagtatcaaagacatttgagtaaagttcacgatgtccagctaacaccaaataattttaccgaattttttgatcataattctccacttttccaggaatgctatgactatcaatctagattgatgcgtgatttacttgttgaaccagatgccaaattcaaagagaagaaaaagaaaaaaaaaggggacgtcaacggaaatcatcctgaaaccggatcgagcctcatcaaccaccaggtccaacagcaaaatgttcgagaacttcaatcgaaaatagccatgaacgacttgatagagattcttatcgatttaaacattccgttttctgttttagactaccaaccaatgagaaattggctcatcaaatattcaataatttcaacagatactttgccggatgaagtatacttcaaaactgatccaggcgtgaatgaactggaacacaacagtagtaatttaaacaatagcaatagcggtactcctcataatcataatcaaaaccaacataccaattaattaaaacttgcttttaatctgcatacataaaacttagatcaaataaataaaaaaaaaagtaaaacaaccatatatactatttcataagcaaaagtaatcaaattaaacaaaaaaaagaaaatacaaatattaaatttaaattaaggcaataaacatatattatacacataaaaagaataattaaagcgcagatgagaactatcttaattatcaaaattctgtagtatcccactcaactgttcaatatcttagccgcaccatttcttcgttatctaggctcactagcaattattttttctcttgattactaattgcatcctgatcgtcttcgatcgaagaaccctgtgaaaagccactaaatgtatgttccaaactatcagggctaactcccaatgatttattgtttcctgctttctgtgaaaccgagatttcttttgaatgctccgctgatttacaatcattagcgtcttcttttccacttgatttatttccgatcgaaattttttcttcaggttcctttgtttgaacagcagaactagtttcggtagcttcttttgcggcagtactcaccggaaccccatcaccacctgaatttttcgtttcggctcccactatctcttccttctttagttcatcaccttcctctattttttcaagttgggttggtaaatcttcaacatttttctcgacggatttgttttgtgttaaatactcctcagaagtcataccaatcaattttttaaccttctcttcgtcaatcttatcatcgccacgtgcagaagcaacatctttcatagcttccaacaaatttagtttttccttctttaactcgatttcggtcgcgttcaactcgctcttacgttcgttaatcaacgaatccacttccaattgcttcagacgggcctccttggttgataactcagcctgctctttagccttattagcaagaataataacgtcatcattcaaatgggattccaagctttctttagtttgacctagttccagtaatttgtcatcctctctgatatttctattcttctgggcgtcaagatcatttccgtaaccagagatctttcttttatggtcaactatagcatcctgcaatcttgagatttctgcgttaatttcatcgcgctcttccactaaagttttgtgttccgcttctgcatttgccagatcgtcatggtaaggtttcaatagttcttcttgctctttgcgcgcttcagtgatatcttgttcacatttcttaccccattcctccaaatcttgatctagacgagctttttcgtcctttaactcttgctgcatttgctttttaaattcgatctctttgctcttggtatcttcaagcagagtttccctttcagcgactttggtatccattctggccacaagtgcatcaaagctggctttaatcttttcctgggaggtctttttttcggtttgatgcctattagccgtagtagtcaatactttggcgtcattagaaatgatagaacgttccatcgtttcccattcatttgatgatttattataggcctcagttctttctgcaatttcttcatccatagcacgttgcgcctccgccctctcactcacttcaccaagtacaggagaaatcaatccggatgcgattttagtgatatcttctggtgacaaaaacaggccaccacccatgttaatcttgttatggaattctgtctttttctgatgattagactgtgcgacagcgacagcagctttgttgtattccatattagtgaatagctttctatgcatatcgcttttttcaatgatatccaattgtctgtcaacattggctcttgccaaagtcaaaacttgctgagaagttaattggctcagataggtttccctcttctgcgccttaagagctatacttttgtcgatatcctcaccaggatgcatgtctttcacagcattagcagctcctaatgcaaatttcatcgacttggcttctttctcagcagaaacttttttgaccttttgtaaatcttgtgcttttggagcatcaactttcgccataatgttattcatcatctcattggagaaactgaattgatttaaattaccatgctcatcagtcttgacgccgtattggaagttcgtcttttccggttcccatctttccttaatacgagattctgcctttttttcagcacccactaagactttctccaaattcaaagtctttggtttaggattaacagtactgttgaaactgccactcgcgccgcttaacacagagctggcagaggtgatagaatatgacctgctgtttgtttgagagcttaaacttgtagtttccattgtcatcgaataagctttcgatgcggcggcccctggagattctttggactttctcttcgtctgagattcttttgaagttttagaagtagcagaagttattgagttgttacgtacaactttgggtcccattttggatgcagctttagtggcattagggtcaataaacatacgtttgtaagcttctaccgtggtttgattgtcatgagctaaattagctgccttgtcggaagctgcatgagcgtcgctgacgccaattgagtaactttgggcaggtgactggtaaaccccgtacttcaacttcgccttatataaagcctccctgcttaatggttcgcctgttgtctggtatacctttggttttctcaaagatttagagccgtgtttcagcgactttttcgacgaagttatagacgaagtcctgctccctccaccagaagtctttcctatattatgtatgtctctatcttctacagctgaaattaaagacattggttattttgcgttggttccctatatgcaaagctatttaacaactaaagactgtgtaatcgtcagagtgcactattttgcttcttttcaaagtagctgccaaagagctgaacctttaggatccactgaattaataaacattggtgatatactgcaagcaacaaggagttctccccatcgagtggcagtagttcttccccctctcgagggtgcccctttcggtagtttgcgattttcttccagaagagcaccgattgccccatccggaaagtactatttcccttttgggtaacagcggaccgaagcggaagcgttcgagtagccgaggtatatgatttcctctttgggcaagttgtaaacaataaatggtaaaaagttatgaaatatattcaatggtaaaggtccatttgataaagtacacattcactgtatgagggaaagaggaaagccagctagagcatttttttggagcaggcgagcaaacaatataaaatacaaaggcctcgtgtgagacttggaaagtgtactactaatattcagaaaaaggtgaaagaatgagctacagttatgaagcttgtttttgggacccaaacgacaatggtgtgaacatccttctgggtcacatttctcagggaataagatcttgcgactcaatgatacttttctttaagcagcgtagtgagcttgagaaggactatgccaggcggcttggagccatcacgggaaaactagacaaagacattggaacaaacatggattatggaaagttgaatgaaacatttaatgtggtgctcagtgttgagaaagctcgagcacaatcgcattccaagcaaagtgagattcttttcagacagatttacacggatactaaggcatttgccgctaacttgcaagcaagatatactacattgagtggaaagattgaaaggttgcggatggacaagttcaacaagaaaaaggggtgtgaggtgttgcaaaagaaattacaggatgcccagattagattcagagacttgcaattgaacgagaataatatgattggggccaagagagtagaacacaacaagagagaactattgaaatgggaatcgaactctcaggaatataaggttcaactagacgttcttaagcaagaatataaggcatcgcagaaattctggatacacgagtgggcgcaattatcctgcgaactgcaagaaatggagaacgctagaatatcctttttacaatcgaaattacaacagttcgcaacctcatcgatggaaacatatattttagagcaaacaaaaatggacatgttaacaaatcatctgaactcattcacggcagcggatgaaatatcgacgttttcaaaagaaaatggaactggtagactgaaacataagacttccaaaggtgacatgaattctagcgccaactgggctcaaatgagcagtatctccacgacaagtaaaaaaaccgaatcgtatatggacaatataaggaaactatcttctcagctgaaggaaaccgaaaataaaaggaaactagcttcaatagacaaatatgagaaaccattgccatctccagaagtcaccatggctacacaatttagaaattccacacccgtcatacgtaatgagacaaaagtggttgctaacccaacattatctttgaggtcttcacccgtccagttacagagcaatgtggatgactccgtgttaaggcagaaacctgataaaccaaggccgattgttggggaagaacaacttaaacctgatgaagattcgaaaaatcctgatgaaaaaggtctaatggtgcataaaagaaatcaatctctcagctcaccatcagaatcaagttcttctaatccaacggattttagccacatcaaaaagagacaaagtatggaatctatgactacatccgtaagttcaatggccaatagtatagacgactcacagagatttgccaaatcatggaactcgtcaaataggaaaagaaaatctatgagccatttgcaagtaccctcatccgcttcttcgaggtcggatgatgggggaagaacgcctaactctgcgcacaacctcaatgaagatgattataacacgaggagagataccagtacaagcacaattttgttcaaacctcctgtggcagtaagaggaacgtctagggggcacacgcatagacaatccatgataatgcaagattcaagtaatccaattgaagatgccttgtacgaaatggaaagaatccaaagtagttctaaaccaggtacaaaaacaggaaacatcatggatgagagaggtgtggtcagggatagaggtattactgttaccttgcctattgtcaccagtgaaggttttccagtcattgaatatgccaaggccatgtatccattgattggaaatgaggcacctggattagcgaatttccataagggcgactatctgctaattactgagattgttaataaagattggtataaaggtgaagtttatgataatgaccgtatagatagaaatcataggataggattaattccctataatttcattcagctactgcatcaaggtctttgatctcgatgtatatcaattttactagttttctgataaaagaaaaaaagtataatgtcagatttttgttaagtagaaatagaaagatatacgctgccgtgggagaaggacacctctccggatttgtaactaaaaatcataaaatatcacgtctttccttcatattttcaaaaaaaaaaaaagttttctttaccatttttgacacaataatcacgataattgttaggtcaggcattccctttccacttttatgttcatttggacgcaataagatatacatattatttaatgtgctctaatgacagttctactgtgtttatatcattagagtcacttgttacgaatactacatatttccgcgcagtggctaaaagcaaatttcaacattataaatctctaatagtaaactgacaatattgcggaattagaaaaaatgtaccacgcgaagttaagtgtcttgaacaactactatatgcattgaatatggctccatttaggcaggacagtattttggtacgtatttagttcatcaatggattttttaagtcttcacgaacagtttttggttaatcttttatactaacaacaattcataacagataatataccccagatctcaaactactctcgttcaatttggtttgaatgaagaaacattcactgtacctgagctggaaataccaacacagatttatcggaccacgagacaagatggttcctacacatatcattcaacgaacaaggataataaagccgaattaatcaaaccaatccaaaatggtgaaataatagacataagcgcctttacacaatttcttagactaatatttgtatctattttgtctgatagagctaataaaaatcaagatgcttttgaagctgaattatctaatattcctcttctactgattacgcaccactcttggtcgcaatcggatctagagattattactcaatatgtcttcgaaagtcttgagataaacaatctaatccaattgccggcttccttagcggccacttattctatgatttcgttgcagaattgttgtattattgatgttggaacacatcatacagatattattcctattgttgactatgcacaattagaccatcttgtctcttcaataccaatgggcggacagtctattaatgattctctaaaaaaactactacctcaatgggacgatgatcagatagaatcattgaaaaaatcaccaatttttgaggtgctcagtgacgacgccaaaaaactatcaagtttcgattttggaaacgaaaatgaggacgaggatgaaggaactttaaacgttgccgagattattacaagtggtcgtgatacacgtgaagttttagaggaaagagaacgtggtcaaaaagtcaaaaatgttaaaaatagcgacttggaattcaatactttttgggatgaaaaaggtaacgaaattaaagttggtaagcaaagattccaaggatgtaataacctgattaagaatatttctaatcgtgtaggattgacgttagataacatagatgatattaacaaagctaaagccgtttgggaaaatattatcatcgtcggtggcactacttcaatttcaggttttaaagaagctttactgggtcaactactgaaagaccatttaattatagagccagaggaagagaagtcaaaaagagaagaggaagcgaaatccgtattaccagctgcaacaaaaaagaaaagcaagtttatgacaaatagcaccgcatttgttccaactatagaatacgtacagtgtcctacagtaatcaaactggctaaatatccagattactttcctgagtggaagaaaagtggatattcagagattatattcttgggtgcccaaattgtttctaagcaaattttcactcatcctaaagatacattttatatcacaagagaaaagtataatatgaaaggaccggctgctctttgggacgtgcaattttaagaatacgtgatagatgcttcgtgtatccaaaatccgtgtgaatatgtgctgtttagttttttccatccaatgaggatgggaaatatatacataaacgttatgtaatatatagaattcatgcaaaattaacaagggaaatatcaccttggttgtgtatatgggacgttgttcgacagaacggattgattttcaccagttccaattgatatgatcttttccaaatcaacttcctcattctcatttgcacaagatgactcgcttccgtctgcttgagcgtccttttgtatccatcttttgaacaagcttacaaagaaatttgccgtcatgacttgctcaacttgatataaaaccaagggaaccaacaacttacccaggtgttcttttttatcgccgtattgtgaagtaattagtgatacacccagtgctgcagttttagccgggccacaaaacataatgcaaatcgcatcttcctttgaataataaaaaggcctaaagatattatacgaatagcggtacaatcttgtagatttgccctctattggttcatgagggaaaagcttgaggatgaaccatggccttgcacataagtatgacagacccgtgaagaatatataaattcccaaattaaaaaagcagagaaatatgatgcaaacatgagaaacgctagtaaacgcatcctgataaaaggcagttgagaatgaactaaacataatcaataaaagcatgtaagatccaattttaatatggtattttttcaaaaagcccaggtaataagcagtacccttcggaaagcaattttgaataacctgacccacaaacaagggtacgaatacagagagaccaacctgtttcataacacggccataaagcgcaccaatgccatttccagtggcagggttgccgtatgcaaatggtgcgcggttagtaaacatttgaaccaatgcaggtgtaataaacgcacccaacaaatttccaatgaatacttcacaaacgcacaaaaggctatttccacctgcattcgtagtcatgataacgtttgaagccacggttgttggacaagtggcagtcaaaattagaccgataagtacccagtcatctattttcggatcattagcagcctttaccgcgcaacaaaatccatatactatggacgaggtaataaggaaactcagaaccagaatagtggcatgagctctccaatttaacatatttgccattagtgaccttgatttcattcccaggccactttggagaaaaatccaggcgacgcagccgtacccaatactatattggcctttaattaaccctccgtctcttgcaaaattcggagcaaatcttgcaataacgattaaaatagccaaacagatgaaaaaccactgggatttcagaaattctgttactgaatgtgcccaaatttttcgtattagagagtactgagtcttcatttggcactaagtaggtgtattaaatgtgtgtcttccttctttttgcaagttatgtcagagttgggatatatcgtagaaaagggtgcgaaggtgattcaggtagcatagacggtttcaggcaataaaaagctataaatctctctttatataattgaaggttaaaatttgctagattttaaagtggttcggttcttttttatgctttcttagcttctggctgttcgttggagctcagacttacgggtagaccaatgtcatcgaaatactgtggaagatcaagctcggaaggagagcgaggctaagttccgagctactgaaaaaaatggaaaaaacaagtgccttaattgaatgactagatgggtgcttgttaacgaaggcgtgctgctattcatgaagctgttgcattgtactgtacagtaatgtttcgagccggatcatcaaaaagattcttacgaaacacactaatagcaatttcatgggttccggtacttctaacaatcaataataatgtggtccatattgcgcaagttaaaggtacctctatgcagcctacgctgaacccgcaaacggaaacgctggcaacagattgggtgctgctttggaagtttggagtcaagaacccaagtaatttatctagagatgacattatccttttcaaagctcctacaaaccctcggaaagtttactgcaaaagggttaaaggtttaccgtttgataccattgacacgaagtttccataccctaaacctcaagtgaacctgcccaggggacacatatgggtcgaaggggacaattattttcattcgattgatagcaatacttttggccccatttccagtgggttggtcatagggaaagctataacaattgtttggccaccctccaggtggggaacggatctcaaactgagtaccggtagagactgcattagcaaaagagccattttagaatgaaaatcagcttatttttatgaatttagaagtgaccccggtattcaaatgcaaattttttatattatgtgattaatctaatgcaataaatatagatgattgtgatttatgtattgatgttgttgccgttcggttcctgaatatatacttctttttttcataatacttcatgcacatgtagtatcattttttatcttcagtctctagagaagggaataacgatcttcttgcgggcctgggtaaatcttctcggtcggaaccaacgaaagtaaaatctccgtcttgctcttcatctccacttacttgctgatgattgcctctctcatcttcgaaactaaaatatgatggggtatccagtccgtccattagtagcatatgtgaagtgcttaggttactgttactactcatagacgacttacttaagatggggaagaaattttcgtcgcctgtactctcacttgaatttaatgatgaaccactagagactcttctgtggtttaatgacagcttcggaggcggctcaaacctgaacgatagtgcagaagatgccattgttgttgaagattgatggctatctctataaaagaagttaggatttgaaggggaagctagttttctaaaagaattatttttagtagcaaatcttttagattctctcctaaacttatccatttcttgttcacaattcagcaaattttcttgtgagttcattcccacgtactgacgtggataacatagttcaggaaaattgtcaaaaacagctttgtatccgccatccaatatcaatatgtcgggatagaataatttgggataatgatcctgatttattatacgatcacaatttctcaaatgagaggccaatgaaggtccccggtgggaactaaattcgcaatggataattaaaagagttggtagagtgttgttgttgctagtatcgctatgcaaaactttatggataaattcgtactctaactcatctctcgagtgtatgttaacggagtttattatgtggccgccagtatattcgtattcaaaccgacaatctataatacgacatgaattataaaatgactcgcacatattattctgcagaatatttttcaacgtttctggagaaattcgagggaaaaagtcatttgagttacgatcgtcataataatatggtatctgtgttttggctaggcatgattcaaaacatttcacccctaccgaattaggagctagtggactggatgacgcagacgtgaagttcaaagtattctgagtaatgttagaaaatttctgtgaactttttctcgatgacctcggaattttcccatcttgccgttgcaccctcctgcttgaattgctactgctattcatgcttggctttctcgacaaggaccttgaccttgaaaaagagctcgacctctggggactgccaggatacttgattctacttaaaagatcattatccctattattggtcaaagatcttcttgatgagtttcttgttggactttgtaaggtttgagaagcaaaatgcatgcttaagactatatcatcattttcattttcattttcatctaactcatcgcgatggccaagctgctttatattcggtgaaggaccatcaatttccttactcctgtgatttgttaacaatggagatttatcaaaggcaagattctctttattgattaaatcatcgtcgacattcgaatgtttgctttttgacttaaagaaggtctgaacatttctaaatatgttcttcttcttaccaaagggacttttcaaggaaattttttggaaactaagaacgtcttcattggcacattcatcttcagttccatgaaatatattgttcatggtttcttcaccctcgctgacttcaatcctggtttgtccactgctctgtttatcttttgtctcctttcaagttaactctcttttctttgttttcgcttgtaactttaagttttctgatatacggcatcgaaacagggaaaaaacagataaagcataaaaaagaaggaaataacagagtgtaactgttggggaaatatcataatgagaatatttaaacgccggaacaatgtatcaaaaagggctttaccgctaataagtggagtatctatgcttttttgacgtatacaatggacagaaaaagcgccatataaaacattgaagcccctcttcatccttagtcctgaaaatgaggcctaggaaattaagtattcggcaaagatacataatacagttctaaaagtagcaaactggtagatactatttgtggcgcagttagctaccccaaaataaaaacggtaatcttctcccattaggggcacccctcttgcttttgtacgatgtggtatcttcgattttcaaactgacaggcatattgcacagcataatgcgcacggaattcattaaactgtacggatatatatatgatattacggtgccatatgatattatacaatattatactgtactgtactatattatattatattgtattaattatattatactataccctatcataccaaatattttggctatattaatttttatctacgtgtatctaagttgttacaggcgggggaactgaattccttcaaaatgtgaaggtaccggaaaaatggcaaagaatcatgataataataacaataagccgtaagcttcataagtcattgaacagaattatcttatgaagaaagatctatcgaattaaaaaaatggggtctattaaatgtctccatgttttttatgagtcttgatgtgttgcgacaaattatcgcttctactaaatttcttatcgcatatgtgacaagcaaatggtcgttcgttagagtgaacagatctcacatgccttttcaaatgttcgctgcgcttaaagctcttgggacaaatgtgacagtggaacggtttctcctcgagttcctttgttgattctattacgacacttgatcttctggacggtgtcattgattttctcctgtaacttggccttctttccttcgtaaccccagcaccattgccagttgagttgacactactactgcttatattattttgttgatttgtaagcggcaccgtacccatcaaaggcacagcagacttccgcctccgaagggaagaaccgattttagagttcatggtatggtgaccctgctgtgggaaatggtgatagaaatgatttgttgcaagagacgtggaggatgatgatgcaggcgataatggagccatattcatttgagtgatggaaagatcgaaatttggagtagaattagcattttgttcaccttcctctgtcaaaaatggcatatcattactcaagcctgtagtcgccactttcgcaataacggacgcattgtctgaaagaatcatagacggtttgataaattgttgagatgaactcaaatttgaattcggcagcatatcgttcttggggtcttcatcctgcttattaaccaggtcgtagcttagtgaatcatcgattatgggtaaagaagctctttgccttcttgaataaagatcgctgttgaaggatttcatgttagtgctactgttattatgtgacgaggtgagctgcttgtgttgaactcggtttagctgttgctgtaattgctgacttggatttatctttgtcatagcattggcatcaaaagaacttgggcaagcagatttgttcttgccagaagtggatgtgcccaaattatcgttgaagttcatattatattcgttaagaatctgtgtcaactcattgtctatggtagcgtcattgtttttcgggttgccagcaatatttgagtctgcatttgcgttcatagtagtggtattcggacttgcattggaacttgaggtagaattagtagtgatattgagatttgtatttctattgcttggattaattttcggatggttccaaaggtccaaagagtgagaaatagaattcctcgaatttgtcattgacggaaattggtttgttataacgtcgctaaatcttcggcgtgataaattagtgtcatcatcatcatcattcaataagagatcactagaaacgtaatcatctagcatggagtctatgttcagtgaattaaaataactggaatttaaattacccgtagaattggagtttgaattagaaatggagttagaatatgaatttgtatctgagttcaattgatttcttagtttttcgttcaaattgtttgggttagtgtcaatgaaaagattcgaattagcaccattaggtaaggacagacgattatctttaatggacgtatgttgttgggctcgaggagatataagagtttcattaccatttgaagtttgaggcgataaattagtttcgttacttgctgtatttatgggaggatttatagtcggattttgaggtaccgatgaaggtgacggtgattgtaacggattgttcatgttgtacaaaatgtcgttcataggataaggtgaagtaagagttgtgtattgatttgccccagagccattagcattattagtactcttaatttcactatcattttcaatagttcttgcatcgcgatttttgttgctatcagctttcaaatgcaagctgttatcggtagtggatggtatcgtttccgttacgggcagtggagagtcgaaagatagtggaggaagccccaaattcagtgaagtttcttgattttgaatgtcattgagatccgcactatctaagacagtgtttttgatatctagagaatacgggataacatcgttgttaatattatttgggttattattctccacgtattgtatactactcatgctttctatggggaataaaatatcttcgctattgaaatcatggtcgaccgtcattttagatctagttcttctatgagcaataaaagttgaaaaaagaaagaaaaaataaagcaaataaaaccaaagaaaaaaaggtagcctcttggcgtatgaaataccttgctactactgttgtgatcttcccgaaaaatatgaggaagataccgataaagtaaggaagaaaaaagcaatatctttttttttttgaacttttcgtattacagactagtttctgttatctccaaggtttccgtctgttttattttcgtgtaacacagtttctaactgggaagtcttgttgagctcgtgctgctttcttactattaccaaacaggaaggcaaaaaaagggaacacggtttacgcgataaaagtaaaagggccaagtctgactggtgctgatatcaggcaacaaacaccactttgttctgctatttgtctttattacctgtctctttcgctggaaacaacaaatataaataagtaagtgtcaatactatatgttgtctgtagaggggaaattgtatatattttcggtgtcttgtttttcttttccgcagtttgtttttcccattctgattttctgaaattcgtaaaaaggtgtttttttcgtataaatggctctctttaatttattagagacaaaaagagccgatatgtatgacgtagacagatggtgtcaagaaccggcttggctgctacggaatgcgtagctgaacgccgtggtttccggagaaagacgaaagatcaactccggccgtctggccaggaacgataggtgctggagataagtgaggtacggataccaagagcgaaatacctctttaggtacgttccgggccgttgttgccggcgaaaccggagggacaaggcaatatgaggtaggattggaaaccggctttggcatattgccacatgcgtatgtacatgtccggcatcacgtggttatgatgtagtatactatattatgttatatctgtattacgctacgttgtgctatcttggatgttctatttgatgttgttggccaaggcatcttttctctcttcccaaacagtcttcccggtacatgcacacacttgtttgttattttcccacacaccagcgcttctcgcaatgactcccagaaatgagtagtccttaacggaggaaggctcgttttctgggtggttcagagacttggaaatgacaaagctgcggccgataagttgccatgttggcaagggagcgctcagaaaggtcttcccactgtacaagttcttgcccaaatcactctcgtcgaagcattcaatgggctcgtcgaacttgtgccaaactttaccagtagattccacgcccttggagacgtcgcctttctcgtgaatgctggcgtggtaatttcccgcctctgggacgccatttacagtgatgtcaaaaagagtcttattctctccaacctgaacgattcttgctaggcccctcacggcggtgtcctttttctggtctatagtatatttttgaaaggtctctaagatagcgaccgcggaagaattcggcttcccggcgcctcttatgatggcgtctttaccacagtttcgcaaggtgttgatgatggttgaaggggctactgagctttccacgctcattatttgttgctctatatcgaaattcaatgaattgattcctgggacattttttaggcatgcctttatatcattcacgcaattttcacagtgcatgggaatggcataagtagcctcgtatgtatcgttcgtggtcatttttgtgctgatcgaatgggtttctgccttgcaaagatatctttattcttttcttagtctaaatttttttttttttggcttgcctttaatatattatttttccgaacaatgaatttttaccctcttccattctcactgtgtactagttgtacggggaaaatgcttagtaagcgcaaatttttttttgatagtatattatactgaaatgtacaagattaacttttgtctggttattataaatcacatatttgattatatgaattgttaaaatgaatttgacaaacagaaaagtatatatttttatttctttttttattttctaataagctcgttggatggaagacgttgacataagcaagctcaacttccaggactattattcttcttcacttatgtcgtcttcagccttgttcatttcagcttccaagctttgagcaaattcttcgtcactagaatttgcatcttttgactcgtttatgttggagacaatatcttcttttttagcttgaagtgtgggtacaggttcaggttcaggttcagctatcttttcttttgcctttgcctctttctcttgttctgcaactgcttttgcctttgcctcctctgcctcttctttttccttttgcttgcgttcctcttgttgtttcctacctgcctggcctgggatgatcaaagtagcattggcttctctttcagcgttttgaatgttttcctcgtgtggaagtagagtaggtggagcaggtttcttcttctttgaacgtggctccaagtcatgactctcattagatgctttggacttatcttctctcctcttctttgggctgttcttgtccttcccgtttttatccttgtcgttattagtactgtcattattgttatcatcttcatattcgtcgtcggacaatagtctaaccattttggtttttggtctcttggatcctagccttctcaaggcttcatcaatattcaatctgtgcttaagcaattcgtcgtatagatcttctgtcaacgaaatacctttcttcccaggtttcatttcgcctgtagatgagtccagatagtactcacggatatcaattaaatttatgtttctaaattgtcttaccgtgaccctcttatttttacccagatcaaaaattgcatctgatgcggatagtccagatggcataccaccattgttattgttactgttacttaagtttcctccaccattatcgcttcttcttttgttcctatacctgttgtaatatgacatagcgcttgtgtttgtatatatgtcgaaaaattgatgtgtacggaaagatttaatattaaatagctttcttaagtgggcaaccaaaagtgtttctttgattggggacttttacaaaattcacgtttacaacctcttctcttgtcttcctatcgttccctggatcaaattaagaattttcatcaagaatagagagcagaaggcaagccaagagagaaaaagaaagagagaaagaaagaaaggagaggaagaggagatgaaaagagaggaaaacttaagttttgataaagaaatttgaggaaggtaaaagtaaaattcccattcaaatgaatgcattaataaattctcatcattaaaaggagggaaaaattacgtataacgtaaagataaaacgtgtgtgtgtgcagtgctatactcattgtccttgttagtgatgataattcgtcccagctgaaaaaactcaaaataagtattacccggatcgaggctgtggcatttagcgccgctctcctgaccatccaccaatggttgataatggcatcggatgatcagcccatttttggtgtattactatcccatctcattcttccaaaaaacacgtatatatcattgacgagatcgagacacgtctgctgtgtttaacggctaacttggttgtgtaggcttgtgtcaattaggcaaaatggttttcttggaaaaaagacaagggaaaaaaaagggctgatagagtaatatatgtacagctggccttctctgagaaaagctagccgcctggaaataaataaatacgcagagtgttcgttagagcatgaatgatgtgaatagaaaaatactaagcaaaatttcaaaatcaagttagtgatgggtgtttatttggcagtactcttttcgttactggtcatcgaaatggccattctgtttattttggtacttccgcttccacagcgtatgagaaggtggctgtatatacgctacagtatcataagtactaataagaaattcagaacttatatggttggaatcatgatcttcgttggtcttttgttcatcgattcatggaaaaggtcacagatcaaagtgtctacgtaccgcaaccagaaaaatccctatataataaatagtgtaaccccagtggatgcactggcttcaagggcatataaccaaaggaatgtttacatttcaggcttcatcatctacttttatatatgtatactcaccgtgatgagtatattacgaagaatagtggaatggaatgacaaaatgaaggctggagatgacattctgaaggaaaagttaagacgaaagcaaaaatatttagaggaattgcagaagaagaaattttaaaaggaaaaaactaaaaaagaagaaaaggaaaaccttacatatgtaaatagaacaaatgaatataaaccaaaatttgacaaattttttttctttttggggtgattatatcatttctggatgaggaatacctgaagaccactcttcattaaaatgttctttaaaaatattcttttggatatattctactagttgtccgtccttagaagataatctgttgccattcgatttcactatttcgtaattatccagagcaagtttcaattcttccatgctactgactccaagaacaacgggtccctttcctacccattccgaaatcgcgtatcttgtggccaaatcggctaagtcgacattttgttcttgacagtatttggcagcctgagatgcgcattctctcaattcatgagaacacgggtgaaactgtcttgtctcctgtgaccttagtagcgacatgctcaagattgatgcgttgcaaaccattttcagtttagcattgcgtagcagtctttctcgaaagttcaatagcttattgttttgtaagttcaagttacaataggacaatactgcatccaatgacccaatatcactttcctcggtagagcagtactcagcaagccaggtgataaagtcgattgggtagcctgatatgccaaaatttttgataactcctttgttcttcaaggtcctcaattcctttaatgcctctaagatgtctggaaatttgacaaactcgacatcgtgcaaatacaccaaatcgagatatgtagtgtgtaatctttcgcacgatctgtgaacactaaatctcacgaaatctctagaatagttaaactcttccgcaccaatacgcccaacctttgtgcatataaaataagtgtctctgggaaattcattccttaaattggacagtgccctaccataaagaacctcactagggccatagtagggagaagtgtcaattgcattgataccatgcgaaaatgcgtatttgattatgtcttccagtggaatggattctggctcatctgtatattgctggttcaatattgcacctcctaagactaaaggagaaaccgaagctaagtcgaatggattcactttttcattaaccatcttatagtctccgttgttactcttttatttatgtgtactcttccttcctgttaacagagtagataaatataggctttaaacttaccgtgtactggaacccagaaggcagcttttttttttccagaaagtaaaataatgacaaaaaaatcgactacatatgcacaatgctaagttatatgacactttctttcttatcctcacctatccataagacacccctcttcttcagagaatttggtaagcaatttcatgtatttccatgagaatggggtcgcatcccagagcgcagctaatatatgaatataagcggatttagctcagttgggagagcgccagactgaagaaatacttcggtcaagttatctggaggtcctgtgttcgatccacagaattcgcattaattttttttacttttcattcgttttcctcttttggtgatgagcagcatcacagaagcgggtgggtcatccattattagacggtaagtgaaaaaaatttgatgattcaggtgaaccgctatggaaaggcatgtagttctgcttactcctagcaagtagctatgcgattttcctgcgccattttttttcccacattagttacatacactctctaaagaatattgctaaatatgacgtcgaatagcgacggttcaagtaccagtccagttgagaaaccaattaccggcgatgttgaaactaatgaacctaccaaaccaatacgccggctttcaacgccatcgccagaacaagatcaagaaggcgatttcgacgaagaagacgatgatgacaaattcagcgtgagcacatcaactcccaccccaaccataacgaaaactaaggacagcagcgacacaagtacggttacgaggcggaagcagccgatcaggtacatcgagaataagacccggagacatgtcaccttctcgaagaggcggcacgggatcatgaaaaaagcatatgagctctccgtcctaaccggcgccaatattctgcttctaattctggcaaactctggcctggtctacactttcacaacgcctaagctcgagccgctggtacgggaagacgagggtaagagcctcatcagggcatgcatcaatgcttcagacactcctgacgctaccgacacgtcgccggcacaggaacaatctccggcaaactgaacatgcgagagtaagagatgccccacgaaggcataggcagatccatatagcacaatacgcgcatataaagtagcattgctgccaaagggggttgcacaaggagttgccctccttcggcacgcggctcggaacataccggagtgtccccctttgagtaatttttctcaaaagaggcacttttgcgctgggccgcaggaaatttccctttctgttcagcacctgttgtcctatattaagctgtgccaaacaaggtcatctccaaatacttaccaaaaagctagggcgtactgtactggaatctctgcttttttctttaccttacttcaatttgccttgtctgcttttttacgtgtgttttggcgtttctgcttttcttttttattactcgttgttgtaaatcattttctaagtattatacatactatatcatcgcatacccaatcggtttcctattctcaccacttttttctggaaaaatacatagcctaacaagcaattttattttacgtttgttaattcattatactgataatatttttgaattttttttttgatacatttttttttaatcgctgttttgtctgtttttttcgattcagttatagggaaaaaaacgggaaaggaaagagaaaaaaaaattagtgcagagcaataagaagcgaaaatcaaaaaaaggttttggatctgcaagacttgctgtcacgcaacaatattatagccacccagcaaaaatgtcagacatcgaagaaggtacgcctactaataatgggcaacagaaggagagaagaaagatagaaattaagttcatcgagaataaaacaaggcgccatgtgacattttccaaaaggaagcacggtatcatgaaaaaggcgtttgagctttctgttctaacggggacccaggtcctgttgctagtcgtttcagaaacaggtttggtatacactttcagcacgccgaagtttgaacctatagtcacgcagcaggaaggtagaaacctgatccaggcctgtcttaacgcccctgatgatgaggaagaagacgaggaggaagacggtgatgatgatgatgatgatgacgatgatggtaatgatatgcaacgccagcaacggcaacaacagcaaccgcaacaacagcaacaagtattgaatgcacacgcgaatagcttaggccatctaaatcaagatcaggtaccggcaggcgcgctgaaacaagaggtgaagtcacaattgctaggcggtgccaatcctaatcaaaactcaatgattcaacagcagcaacatcacacgcagaattcacaaccacaacagcaacagcaacaacaaccacggcagcaaatgtcacagcaacaaatgtcacagcatcctcgaccacagcaaggaataccacatccgcaacaatcgcagccacagcaacagcaacaacaacaacaacaacaacaacaacaactgcaacagcagcaacagcagcaacaacaacaacccctcaccggcattcatcagcctcaccaacaggcttttgccaacgctgcctccccctatctgaatgctgaacagaatgctgcctaccaacaatactttcaagaaccgcaacaaggccaatactaatcttatcgatttccgtatataattcatagacgagcattaagaggaaaaagctgtttccgtaccaatcaaagaaagatagacaacaaaaacaaaaacgtacattactctatattgaaaaaagccctatgtcggtaaaagaataggaagtactttagtcatcggcacttacctttttttttacgattacttctggtttgtttctttgcctcatttcattttgctgccactttctttcataggcaagaagattcaatcaaatctccccttctccttccccggatatataaaatataaatataaaactttaagaatataaaaatatgagaaaccacacataacttgtatactttactcacatacacacatttccaaaaaaattataatgttaattacattgcttttaattctaatctttttttagttgtataatcatcaccatataaatgcctctcggtctaatttcgttgccagtattgtaagttatatacttttatacgagtgtacggaaaatatcgtggctccccgttaacagtgaaatatatctacgcatgtagctgccagttttttaagcgttatatcaatattggtaaagtaagaattgacgaagaaattgttaactacatttttcagaacggcgtgtcattctccgataatgtctgaagcgatattccagccaacggatattgttcttgccaaagttaaaggcttttcagcatggccagcaatgattatccctaatgaactcatcccagataacatcctcaagaccaagcctgtgagtgtccacaaaggcaaatcaggtagtgataaaaaagcaaatgaagatattgacgcagacacggaatcagaggctagagatcgagagcaaagcgaagaagaagaagatatagaggattttggtgagagtgaggataatcctgaaaaatttataatatacactcccgttctgaagtttcgtaaaaatgatacgttgaaatcgacttactgcgtcaagtttttttgcgatgattcttatatctgggtgaagcccacggatatgaagattctaacaagcgaagattgtcgtaagtggctaagcggcaaacagcggaagaataagaaactcataccggcatatgaaatggctatgagaggcaaaaatggaattgatatttgggaatttgtggaatatgggtcttacggcaagccagatgaagaggaatatgtagaggaagaggaagaagagaacgaacctgaaaaaaaggctataaggccaaccaggtcttccagtagacagcgtcagaagcgcgcctcagaaacggaaaagagtgagggcggtaatagcaataaaaggaaaagagttactagatcgactaggcaacaagcgatagatgcttcagaagaggaagaggaggaagaggaggaaaaagtacaagagactgttagaaagaggccgcaaaggaccaaaactaagaaagttgtagtatccaagactaaaccaaatccaaaaacaaaggcaaagaaagagaaacctaaaccacctaagccaatcaaatatcattttgaagatgatgaagattggagcattgttgggttgggcccacaagatctatcaatcgaaaaaacgatggatccgattgcgaaaaaactgtcgcagaagaaaaatctagaaaagcatgtggagattaagctagatctcgaggataaactagcaggcatcaacaagctcctgtgtgatgtcttatgttcagctattaaccaggctgtttcgataaaggatgatttcgaaataatattagatgaattgcagattgcccttgacaccagggggtccagaaacgaatttataacaattttccaatcaaataattccctactgttaaactttaggatattatttaacttaagaaaaagagaactgaacaaatgggatctgtgggatcgtttccaggatattttcaagcatatttattcctaccagttcatacctgatacggaagattggcaactagagcaaaatatggaaattgaagaaatggatcgggaaaagccgagctttagtgaagacgtaaaggaagaagaaagcaaagtaggagcatgacctgttgctattgcagttgatgtactctgcttttgaacaatagaggggaaacctgtgtactataaaatagactaaaactatgtaacttgtgtatgttctgatatgtatgacgtagtctttgatagtccaaaactcacctagactgtgctgtattattacaattaaagttctaagtctgttgtgcattatcattttcaatgaatctgtgaccttggcattcgcaccacttgacactacaggacgaataaattccatgttcggatggtggctagaggtacatatgcggtaaatgtactgtatagttcagcatgtttttcttaataatccaagtttgccatcttagtatagtggttagtacacatcgttgtggccgatgaaaccctggttcgattctaggagatggcattttcttttttttcaaagaaaagaaaaagggaaggcaacaaacgacatgaattattgtctttttcaaaaggatgtaattatcgcagcaggtctatgaagggtcccttttctcttttttatcacttgttccatctataattttatactcaaaaatttaacaggttaattacactaaatgcattacaaatttgtatttgattctatatatattttcgttatataataactcaggtctgctctgcagcgtggtttacgataaacacgtatgtaccactgtctgcatcatagctttcgaacttagaatttggatttttctttaagcgttcgatatgccttttaacaagttgatgatttggatcctttataggttttctggtagatttgtctacaggataacagttaaagcaggtaatcctggcccgaacattaatgccctcccctctcttcggtctgtttggcaagttcgcatatattatacaggtttttggttcaaaagtaatgattacgccccctaatgaggtcaaaggaattccagcgaggtcaacaggttcaagaaattcaattttaccataacttttatgacccacaactaaatgaggaactttgcgcagttgcaagagagaataagaggataatgtgtccagggatggtgagatatagtagttctcattaatgaaggaggcatctttttccgcaacgtccgcaaaaacagcctttttatcatcttctgaatattcttgcttctgtaaatcggcgacattttctttattttcttcgtccatattccgggaatgatgtttcgttgcgctatcttccccatcgttctttgaggacaaaaccattctttcccccccattagcagtttctttttcatccatctttggctttcccaagatcgtttcttgttcttcacttttacttttaaaattcatatcgttgttctgtgatccgttattcttttcctcggatgcgatcaacattttcctgttattaattagattcttgaatgaccttttatcgggattgaataataactcagaagcttttaatatgctttcgtccaaattttcctcctgctggttagaaatcgcaatctgattattctttttatcaatggaaatcgacaactttggatcaaccttgatctgggccttatccatgacggaattattaatcttgagcttggctgtaaataaagttttaggaatcattttgtatgcgttcgtcaaactggcttttttgcgttcatcggctttgatctttgtagcgcttggttgaattggataggaaaccgtgttggtgacagttgctttcgaaaaaagctcattagtaccgtagggattgttattctgaatttgtaatcgttgttgctgctgctgttgttggagcgcattttgtgattgtgccattggctgggaaggttgggaaaataaccctccgcccgaagtgttcgtactagtattattctgaaataagcctccagcattagtagattgagaggtattagtactaccaaacagacccgttgaaccgttggaattgtttagagacgagttgttattgtttccaaatagtcctccagcacttgtagaagctcctgcaccaactggtttattaccaaataaaccagtagaattggtggtggccgccgtgttagatgcattattggacccaaatattccacccgaagaggcgtttggagccgtggaattagtacctccgaaaagggatcctgtagcaggtttgctaccaaataatccgccgctagttgaggcaggattgttttgatttgcaacttgattgtttccaaataatccgcctccaacagtgtttgatggttttgaaccaaacaggccacccgaagcaggttgctgtttattttggaacaaacctcctgattgctgctgcaaattatttccacttataccgttactttgatttgttgtgctgttagagaataagcctgtatttccaaaaccagttggtttcgctccgaaaagactattattctgttgtggttgttgtaacccattttggccaaatggctgattattattttgattggtctggccaaacaatccaccaggttgggactgcgactggttgttttgttgtccgaataatcccccggttgattgctgttgttggttattttgcccaaatatagaattattttgggcattaccagacgcaaaagtggatgctccatgctgttgtccaaatagtccacctgcaggtttgcttccaaataatccgccttgttgctgtggctggccaaatgcgtttgaggagttttgttgtccaaataatccggattggttctggctttggttattctgaccgaacaatcctccagcgttggaattttgttgctggccaaataaccctcctccactttgctgctgattggtttgcccaaataagccaccagtggtaccagtggggttggtattcattccgaatgcttttgaaccagcagattgtccaaatagtccaccagaagcaggtttagctccaaaaagagcaccagtgccttgctgttggccgaaagcgccaccatttgcgttagcgtttgattgaccaaatataccaccactaccttgttgtgtttgttgttggggaaaggcgccacgattcacctgaccaaaggctcccccgttactgacattattcgccccaaatgaattttgctgttgaccaaataatcctctgtttgtatttgagttctgctggccgaaaaggcctgtattattagtgccgtttgttgggttgttagttgtattaccaaacaatcccccggaagtggcaggtttatttgctccaaatgcagaatttcctgagaggttagtggagcttccaaacaatcctgtagagttggtcgctccagagccaaagccaccaccacttccagttccggttccaaacatgcctgttgctggcttttgaccaaataatcctcctgttgtagcagaagtagtggagttattattacccataattccaaatccagtattggtagttccttgaggattgttaaaagtagtaccagtgccattttgactggtaccgaattttctaccagcttggtaatcttgaaatctcaattcttcaaaagaaaaatttctgtattcaggcatacaggtgatactttggaagacgttgatgacacctgtcgttggatccttctcttcgaatgtagtaaaaggtttaatgcttgtacctgcagtagaattgggcacaacagaagcggaaccagcagaaagtgctgtgttattacccattccaccgaagatcgagccagaggcattgttgttcgtcaattgactttgaccaaaaggagtatcatttgctgtagtcgagcctgacattccgaagggagaattagaagtttggttaccaaagttaccaaacgcaggtgcttgcgttgtatttgtttgctgactgaggccgaaagcagaagtgtttgctactggttgttgttgttgctgttgggcaccaaaggttgatcctgttgagccaaatggctgtgttgttgcgctggggaatgcgccacggctaactccaaacatagtaatgttttaaaaaagaaatcttcgaagctgaatggtgcctctcagttgccgggatctctatgcaatgctgatagtttcctttgcgaccttatgacactttattaactctaagtataatttagttttgttctttttctaatgagcatggtaaggaataatgccgggtaatgataatctgcaaaagtgacaataataaactgacgcgtaacaagatcaatgatatactggactaaaatgccatgaaaacgtgaacagaaacttttattgaggtcatggatcaagattttgacagtttattactaggtttcaatgactccgatagtgtccaaaaagacccaactgtaccaaatggcttggatggttcagtagttgatcctaccattgcggatccaaccgcaattacagctagaaagagaaggcctcaagtaaaattaacagccgaaaaactactcagtgataaaggtctaccatatgttttgaaaaatgcacataaaaggatacgaatttcctcaaaaaaaaactcatatgacaacttatcaaatattattcagttttaccagctttgggcacatgaattgtttcccaaggcaaaatttaaggattttatgaagatctgtcagacagtaggtaaaacagatccagttcttagagaatatagagtcagcctttttagggacgagatgggcatgagtttcgatgttggcacacgggagactgggcaagacctggaaagacaatcacctatggttgaagaacatgtcacttccgcggaagagaggcctattgtcgcagatagttccgcgcaagacaaaaggaatgtcgattacgataatgacgaagatgacgatatctatcacctttcttatcgcaacagaagaggacgagttttggacgaacgtgggaataatgaaacggtacctaacaatgttgtgccgcctaaggaaaatttggatgcattattgaagacattcagggtacaagggcccgttggccttgaagaaaatgagaagaagctcttattaggatggctggatgcgcatagaaaaatggaaaaaggctctatgactgaagaagacgttcaactgattcaaaatttggaagagtgggaaatgaatgatatagagggacaacatactcactatgatttattgccagggggagatgagtttggcgtagatcaagatgagttggatgctatgaaggaaatgggcttttagcaatgtctttgaaggtaataatccaaacgtgcgtgtgggcatctatacatataggtttatatatattgtgtaaataaagcttgtagaaagagcctggttcgagtgtttgattttttcttcttgggcgttattatacaatatctgcttcaaattatatatctaggtggtccataagcgagccgtattatcggcaccggcagaaaacagccaagcttccctcggatgccaaatagcatcaagaacacccagactattgattactttatgaccggttagtttctttagtggcacaatcatcggatttttcatcatgtcgtcataaacagtggcatggaaaacatgtatggtaccgtcatcagcggcagagctgaatagaggtaactttttgtggaaatttacacttctgacggctttttcatgatatcttagtgtcttgtaaggtgtgctagccaaatccaggtcgtgccataaaactctcttgtcaaacgatgacgcaattaaattatcacctcttgggtgaatatcgattttcgataaccaacgggcaccaggcaacagtttcttgaccaatatttgttgagataaatcataaattctgacatatctttgggaacagacaaataattgaggtttaaaaggatggaacttcgcatccataataatgcccttcgattttttgaatggggattgggttaaatgcttggaaacttggtgaatcaaaacagaagtgttaccagagtcaggttgaacagtgacaaagtaatcaccttttctatgccatgaaagcttttttactgtttttttgcaagaaatagtgatacaaatatccttttctagttgcttttgagaaggcttgttccattgggctacttgtttttttacagcattcttagctgattcattctctccatcttcatcgccatcaccattctcgttcacttctaggttagattttttaacagtcccaaaagtatcgtagccaaaaccatcttcaatcttagtttttccgttattttcaatatcgtagccgaatattggtggtactattaaatgaatgttttcaccaacagcaacggcgagaataccattattagcatcaggattccactcaatgcattcaatgtggtcatctgggttttcctcgtcatcgattaaagtagttctataaacttctctaccagttaaaatttcccataccctgactgttccgtcatcagatcctgttgctagccataatccagaaggatcaatggataatgtgcgtacttttcctttgtgaccagcgtatattgttgagcaacgaatagggaagggtcttaaatccttgggagagggaagttctggaattagagaattaggatcaatattcaatttgtttttacggacacgaggagctaaatataaatccaaagatctttcaaatctttccctaatagattcaccgtaaccagggacctttcttaaggcagaatacttttgaggtacgaagtttctttctctttcactatattcagtattttcccaggcctctttttcttcaggagacaaaagatactcttctggtggattataactctcttcattagttggtggaggtaattttggtgcccttagatgcattacatgatcatttgtttccgtagaatcaccccataaatcgtattgatagttttcagttttttccttttctttcatttcctttaattttttaggaggaataatacggccctctctgatagctcttacaattttcataactctcttggcttcgtttttggatggaacaaatcttctttttggctccggaacagcagttaatggcatcacttcttcgtgtctcgtgaaccagtcgattaacggttcgtatggatttatgctatcatcagtttgttcgttcctttggattttggaaataagttctaattcctctttggttaagttcaaacttgaaccggaattcttgtccagtaaaccagtccagccttcaggtagctcgatagaatccaacagttgatctaaagcagaacccttggcaggtctcataatccttttaccgttgatatcgtatccaatgtgtggcatttcatcgtatgcagaaagtggaatattaccaatggtattttgcgtttcggcatcactatcatcgctatcataaactggattaatttcaggtttgataattctatcactgccatctgcatattttgagtaaatattcggatcaacgatcgtttgcaatttcacacccgataatctgtctgttaaggaagttgtgtcgtctgaaaactcggaactgtcatagtcctcttcctcatcaccttcttcttcggcaagcagtttgtttaattcagcatcggagtcatcatcagaatcatcttgggcttctttatcagaagatgattccttttcttcaacggcagactcgtattcgtcatcatcctcgtcactctcacttgcttccgcatcgatcaaaccgtcaacggataaaagcttgtcctcatcttcctcgacatcagattcttcgctagctgctctctttttcgacatctttgcctcggtagttttgttgttcttagccatcattgacctagttatgttagaacagatttaatacagtacctttcttcgctaggaactatatgcgaatatatcacatatgtaaattataagctcatcgacaaaaccaaaaaaaaaaattttcaataatttttcactaatcttcaaaaacaaatggggtaacccgtacaagagttattaaaacccaaaatgacgaaatcgcgacaatacaatcctacttaattagcaataacaaactagcggtagagctactatcacatgttaaaccttgaatgctcaattcattgtactcaatactgctattaaaagaaaaaaaatgtattaattatattcttgtcaaaatcaattttacattataagaggaaaatgttcttcagttctagtaacattagttttctccctttgctagagactttacataatatcctggaaggtaaaattcgataatacagcagtaaagtcgtatattggtagcaatccttggtggcgctgacttttttttttgtaattttattgtttagttcatgataaaagacttcaaatcacttttaatctggtagacagagaaaacaaatcaaaacgaaaatagggaactacgaataagaaaatataagtggagaagatcgtcactacgcattaaacaatattgatcgctcaatgccagtactgcgcgtaaaagtttagtaacttaacgatttaagcacaatttgagaaaaatttcgccctgcagtaagtatgttattcagtacgatataaagctgaggttttatgctagcaacgttcagattttttagattatcaacaattttaaaatattaaataggatacttttattgtttgagaccaccttcaatgccagatatgttaaacgcttttttccggagtgaagtgtcatagaaaaaggctcgagtacatcaagcacttaaaggttcaacactctactgttacttcttcaagctaagctattcatacataatagtccatcaaagtggctcaaattgcgcatacagtgtgaaaatgcgttcaaggaataacgatgtcaagcagcgtgtgaaaattggacacgttgaataataaacttcctggaaaccgtcgcgcgccactgctgtcagaaaatagtagactacttaattttcaattcatatttagcctgatttttgatctatgaaatcgcctactctaaatcagcggtgtttttgcacggtttgtaattttaacttcattatatgtattattcggtgacttctctaaaaaagaaggatctatgcaatattcttatcttctatttttttcttttcgatttttggagttaaaccttcgtaatgaacaggttcgatcagtctacagctgatgacaatttcatgttaaactttcattgatgataatggcgcgcagcccacctgttgaagaggcagaacgaagaactattgcttataacataggtcagtgtatactggataatagtatcgaataaccagcataatattttctctggaaatacctttaaggggtttttagaagaaaaacaaatcctagtgcaacttgcaagtcatcaaaaataatctatcttatctctatatatatatttgtgtattttatattttatgacaaagctagaaatataaaatcagataccgcaatagaagatatttcaaataataataccaatctcatagctcaaaacaggcactaagggaatactgaagaaagtaatgtctaggagttagtatagcttgaagttgccatcggtgtcatttaggtatatctatctagattacgcgcggccttcagaaaagcaagtgatttctgaagtttcaacctacccagactattcacataaggttaatttatgattgaacagttcaaataaatctgcgccattcacgaagatgattcgataccgcaatatgctgataaagtgctaaaaaatgatttcgcccaggatcgaactggggacgttctgcgtgttaagcagatgccataaccgactagaccacgaaaccaggctttattgaaaaattgcgtttaaaataacctatactaataaatcttctagctcttcgctgttctatgtgatatcgttgatagttaggttttcgtgttgaaataatcaattacatttattgactggtttaatattaatattgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattacccacacatttctcaaatatattatcatatacagtgtaagaaggtgatctaaagattgagaaacagtcaccagatttaggggaagctgaaatgcaaagattgataatgtaataagaagcgagagggaaagtataaaaaggaagtgatcaatttgtgaataatttaataaccgttgggattctattgttggcaagggctttattttattatgtgtacagaatataatagaatttcccctgagagatatacgaatcctcaaattggaatcgatactcctatataatacaattacaattatttctccctccctttcgtatgtttcattatcctagtacattatcaatccttatatttctgcttccattaaattttgcgactgtttctcaatgtttagatcatcttcttacactgtatatgataatgtacgagtggcatgaatactactgaacagatgatattttatagcttcattccaacagaaagaacataaagtaatatcgttacgtgaaactatcgattcccttttgacgattcctacatcctcgagaagaagttctagtatattctgtgtacctaatattgtaggttctaacaacaatggaatcccaacaattaatcatcttgattattgtattccccgcgttttagagcatcaatctcgcccacttatagctggtcattgtcgacgataatctcaagcacagggctaaaaaataaattgaaacggacaggaattgaacctgcaacccttcgattgcaatcttattccgtggaatttccaagatttaattggagtcgaaagctctaccattgagccaccgcttcaacttttattgtttatattgacacctgtataactatataaccacaataaaaggttcattcaaagctccggctagcattcggcgattaatgaagaaagttaaaccgtgatttattacttcttgctcgttttttccatcataagttcgcacagagcagtatatatagtgatttgcaaatatgaatagcggtggtagtgatagtttcgattatcttcttcaattaacaaaaactttaagtgcagagtgtcgggctaacagacaagagaccgatcgaatagaactattgttaaagcgccttgccaaacagtcaggaatatcttatgataatttgagcaaaaacataattccagattcatggaaagataatgcatctcaaaaagcatctccccccactgaggcacagaaacttatcagcgaaaattttaaactcatatacgagattgaaaaacaagagtacttcaatacaaaggctgttgcgctaattaacaacataaatgagcatttctcatatattaaaaattttatcgacgaacagaatgcaataagagaacgaaatattgccacatttacatcagaaaagcttgatgaaaggaacaaaagtcttcaacaaaattacgagtcattgaagacagaaaatgaagaaacaaaaaaaaaattgcattcaattatcaaacagtttgaaaaacttttgaaggaagtggattgggatcgtatatctaaagattccagagattacagccgctttaaaaaacagttggaatacctgcaagacacgtaccaggtactgaaatagcctacgatagatcgaacaaaagtgtaagcagacgtgaaatagcaaacctttgaatgcatttatatattttaatatacttataacaacggataaatgtttagatcccttttgaaaaaaaaaaaattaggataaaccgaaaaaaatcatactcgtattcctctatcgtcttcactggcattattgtgtaaagaattattaccaaataaccacctgaaccaccccacagtatcattctttaaatctttaaaataacggcggctcagcatctttaaacaaagagcttcataggtggggttgttagtggtcatcaaatcatttacgcatctatcatattcgtctttatcactcttgggatctattgcagagcatattccagttttaccctgtccctgaagagagcttttcaacccaattaatttggaatcaaactgagcaacactactttcaatatctcgtacacgaacttccaatatcctcatatcatatttcaacctagatgataaggaatttaactcttgcatctcatggagaagaagttgttgcttattgtcaatgtcttcaaatctcccttcaaacacttttgcaccatctgaatacttcttatatagttcttgcagtcttttatatctttcgttgaatttagagtactgaccaacagttccctccttatttaatttacccatataatgctcatccatttcttgtatgtgttgctgcgcttggatgtcgtatttcattcgtaacaaatctctagctattcgaacaacagatggatcgaatggtaaatcccatttctccacaatattctgtacagcagaagaagagttgcatctatacaaacgagatgacttttccttcagctctgaaagatcttcataaatgttgtcgtgtgtgcgatctttacaatagggaaacgaatttcttcggtagtattctccttgatataatttgttgatgccaaaattatatgcatatttggtattatcgtagtttggaaacatcgatgacactgttgcagatgagggcatagcattggtcctccctatgtcttcagatgtatcaagactggaagaactaacctttttggaggcgtgcttttgagcgtatgcgattctttccaaacgaaatttttctagtagcatttccctttctcttatctgcccatcaggatcgcctctctggtagttaaatttcaaaaattcttcattagaaatatccgtacagcatttccttgggtgccccttacctttccatagtagtcctacagagcctccatgaatattatgaataagtgtatctagatctgttgtaagaattttgtgtgacaggttgatgggatttccctttcctatgatgtcctgtaccgttgatgtcaccattttcttcagtttaaaaatgtctttgctggaaactttcgctgtcacttcaaagagtttctctaacgttcttgggtctaaataaactctagattttcttttattgaggccatgctttttttggaaattataaataccttggaagaaaccagcttcatcaaagggatccttagaggaaatgcaattttctatcatcaacttgaaatagcaacaaaggatcaaactaattaggccagctactgtcgtcggacccagtgtgcattcattccttggcttttctgtaccaaggtacagtttcccgtaagtttcccaccattcatctatagctcgcttggtgtcttcacacaaaagaccatccgtctggtagttcttagataacaaattgaaataactcaacgaaatttgaattaaagttaccatctccacgactggtgatttactatcggtatttcgacactttgaattcccaaccgtcttgtattcttcctcaggcaaacgcggttgctgctgctgaatcatttggggatactgtgcaataaaaccatttgtagggattttgaacagttgtgaaaacttatcaagtgatgccatagttggagggcataacagatttgctgatcttccaccacaatgcaggtttttcagatcaaaattaacctcgaaatccttccaaattgttctcaagtcaccacattccacatgcaacagattcaagccaaaggacacacccgaaagattggtaataaatagagtgccctttggtgtaaattttggccgcgcaaattccattaattcttcaaaatactgtctaaatctccctggccacatactcgtatcctttggcaaaacgactctgactcccgatattgtatcctgagagtttcctgtatatgacgtaatcaatgttgacaaattcctacatgctacccattgctccacaatatatatttcaaacccgtgtacgataatttcttcataagttaaatcagcatagttgcctaaatctaacaagaacaaagccctagaatctgggaatataaaactgtcgagaggcgggagctggctcacagtatcattctttatcaacccaaccacttccgaatcatctgagtgaccatagtaactacttccactgtaattggtttcctcattgtttaattcatcgtaataatcaccgtttgcatctttttgtccacgttctccaaagaaattatcatcgagtgtatccctagtggagtaaattctttctaaatcctgcatatgttttccatcaaactggctagttttgtctcctgtggcaatagtatccgccataaccatacatatttattaataggtgcttcttccagggtctagttcattacctcccctaaatatcattctcagatcattatagcttctatttcctgttatgcgggtagcggggcttatttttgtttctcaaaatagaggtgtccttttttgccatttttgtttatgtagtcaactgcataggtagttaagaaaagacataggcccacgaaggtgattggaagttcagtgttgacaataatagaatagtagcacactctttttatttcgttttgcttacagttttgtactcgcttttgcttttgcttgcaaataatatcctcgtgacctcgagacttacattaaggtgcatatcataattcgcaacagacgcattcttattctctaaaattcctcgagttatatgaataattatgaatcaagaagaggctatattccggtcagcagacatgacgtacgtccaactgtacataccgttggaagtcataagagaggtaactttcttattagggaaaatgggtgtctttatggtgatggatctcaataaagatttaactgcgtttcaaagaggttatgttaaccagttgaggcgtttcgatgaggtggaaaggatggtaggcttcttgaatgaggtagttgaaaagcacgccgcagagacctggaagtatattttacatatcgatgatgaaggaaacgacattgcccaacccgatatggcggatctcatcaataccatggaaccactatcgttggaaaatgttaatgacatggtgaaggaaattactgattgcgaatcccgtgcaaggcaattagatgaatctttagatagccttagaagtaaactgaacgatcttttagagcaaaggcaggtaatattcgaatgctcaaaatttattgaagtcaatcctgggattgctggaagagctacaaaccccgagattgaacaagaagaaagggatgttgacgagtttagaatgacccctgatgatatcagtgaaacattaagcgatgctttttcttttgacgacgaaacaccacaggaccggggcgctctagggaatgacctcactagaaaccaatcagtcgaagatctaagctttttagagcagggataccagcatagatacatgataacaggctctatcagaagaacaaaagtagatatattgaacagaatcctgtggaggttattgcgtggtaatttgatctttcagaattttccaatagaggagccattgttggaaggtaaagaaaaggttgaaaaggactgctttattatttttactcatggtgaaacattgctcaagaaggttaagcgtgtcatagattccttgaatggtaaaatagtctccctgaatactcgttctagtgaattagttgacaccttaaaccgtcaaatagacgacttgcaaagaatcctggatactaccgaacaaactttacacacagaactgctcgttatacatgaccagctgccagtatggtccgccatgacgaaaagggaaaaatatgtttataccacattgaacaagttccaacaagaatcacagggtctaatagccgaaggttgggtgccttccacagaattgatccatttacaagactcattgaaggattacattgaaacgttgggttctgaatacagtaccgtctttaatgtgatcctaaccaataaattaccacctacataccatagaaccaacaagttcactcaggccttccaatcgattgtggatgcatacggtatcgcaacatataaagaaatcaatgctggtttagccacggttgtcacgttcccatttatgtttgccattatgtttggtgacatgggccatggtttcattttatttttgatggcactattcttggtgctaaatgaacgtaaatttggtgccatgcacagggacgaaatttttgacatggcatttacaggtagatatgttttattgttgatgggtgcattttctgtatatactgggctgttgtacaatgatatcttttccaaatctatgacaatattcaaatcaggctggcaatggccttccactttcagaaaaggcgaatcgattgaggcgaagaaaactggggtttatccgtttggattggattttgcttggcatggtacagataacggactactattttccaactcttataagatgaagctgtccattctaatgggatacgcacatatgacttattccttcatgttttcttatatcaattacagagctaaaaactctaaagtggacataattggtaactttatccccggtttagtgtttatgcagtcaatatttggttatttgtcgtgggctatcgtgtacaagtggtcgaaggattggattaaagatgataagcctgctccagggttactgaatatgctaataaacatgtttttagcaccgggtactattgatgatcaattatattccggacaagccaagttgcaagttgtactactgcttgcggcactagtttgtgtcccatggttattgctgtataaacctttaacactgagaaggttaaataagaacggtggtggtggcaggcctcacggataccaaagtgtgggcaatattgagcatgaggaacaaatagcacaacagagacattcagcggaaggtttccaagggatgatcatcagtgatgttgccagtgttgcagacagtatcaatgaaagcgttggtggaggtgaacaggggccatttaatttcggcgatgtcatgattcatcaggtaatccatactattgaattctgtttaaattgtatctctcatacagcatcatatctacgtctttgggcactatcgttggcgcatgcgcaattatctagtgttttatgggatatgacaatttcaaacgctttcagttctaaaaactcagggtcgcctttggctgtcatgaaggtggttttcttatttgctatgtggtttgttttaaccgtttgtatcctagttttcatggaaggtacttccgcaatgttgcatgcgctacgtttgcattgggtggaggcaatgtccaaattttttgaaggtgaaggatatgcgtacgaaccattttcatttcgtgcaataatagaataataaccttaaattactgtaaattttctcatctacccactgcttttttcgttttattttttttacacatacagacatataaacgttgtagaattaaacgataaaatataatatttcttcacatagtttacggtatatatatgtctgggtcggtcaagtggtctaccaataggtcataaatttgagcagggatcttagcgatgaacccgacgcccagccgaatgatctcgtctgcatcaaaatccggaaactgtcgtagtaaattaacaggggaatccgatttgaaaaccttggatctcattttaactaggaatgccaccacaaagagaatattcatatggaatccatatgcaaacatgaaatcccacagtttaatgacctgatcaagcggtttattgcagctggataacgtgagtatggaaggcataccataaatctctgctgtaagtaaattgtccgatagaaatttactcagctttggatcaatgattctgagagaaatatctagtagtttggcgccgttctgggcgccgtttaggttcttagttagatacgtcggtatcatttcataacaaagcttagtgaaaagttgatacgccataggttcagaaggacatgagtaaagcagaggagctaataacacgttcatgccctgcacatatgtgctcacaggaatgcgaccaaaacgagtcttttgtcttctttgttgtgtttgccaagcaaagcacgacagacaccggatgagggcatcctctgagactctatttctaaagtttggatccgtctgaaaagttctggatgtgtcgttcttgattttttggtaaatggttgtggaaggtgggcccagtttcaagagcgcaaggtaccgttgtgtagacgcctccatagaagtttgagagagcaccgtccacacgtaacatcgcgtgcgctgctgctgtttatcttcagatatgggaagcccttcactgagtatgaggtagcgaagttgagagagtgaggaatgcagtagcaggggaggatttgatatcagatcttcaattgaggtcatgcaaaaattaacaagtttaaaagtctgttgtttcttttacctttacgtcgttactattattagtattattatctatttttttttttttttcaatgtttagcttggcgtacgtaaacggttcccttccgcacggcgtttactgaattgtcgggacataaattcaaagaagaaagaagacctccagtgtcattatagcataagacaggtatgtagcaagaatgaatatgtaaataaatagcaagaatatgtagaatttttagattttattcgtttgttgttttctttttttttcacttgaattttttgccaaacattatgagttgcaactgatcgtacaatgagatgacaccagctgcagcgactcctctaaatatgttggcaccacagcccttgaacaaggaatacgcgccctctttctgaacaatctttctcaaacagtccagagcaccgtcgtacttgatggtctggcccgaagtcatcatcatccttcttcttaccgtatccaagggatacgacgcagtggaagcacccatggtaatgacccaacccaataggaaagaggcaacaaaggacccctctagagcccccgtcaacagtacaggcttgaaagaatcgtacaagccaaagtacagacctctgtagacaatgatacccagaactgagggcacaaacccacggtacagacccaacaacccgtccgttttcagtgtcttcttatacacgtctagcaatccattaaactgtctttgcgaggttgacttagaacccctagcatccgctgcaagccgcgtccttgcgtagtccaaggaatatacaaatagaagcgacaaaccaccagccgctccaccagaaaacagatttccagcaaaccacttggcatacccatcgcgctctctgtcgtaactcaacaacgacttaattttgtctttgaaggcaaaattcagcgcctgcgtggggaaataccggagaacattggcggtgttacccctccagaacgacacaataccttcatgagtcgcagtcctcttgaagcaatctaaaattcccttgtaccgtgtatccaacgagccctgtttaagcatctcttcttgattctgcatcaacagtttcacccgttcaatgggagcggcacccgtcttcgcaatggcagcagaaacgccgcccataaggaagtccataccgaagtgtgactgctgagtctatgtttctgtgtgagacattactgctgtaaaaaggaaaaatagaaaagaataacagatacgagaatctgtgctgccttctttgcgataatgccttggcttgcctatttcacggttacaggaataataacatgttcataccgtttcaggaccaataaatggtcttctgcgagagaaaaaggacactctccgtccgacagaaataagctttactttccgggtgcgagtcagcccgttgcgcctggggtggtccctacagtacgctgagtcgccgataaagaccctccgcctagagctaggcgaggctgacttaggcaggcccaacaggcaaggcccatcttcaaaagtgcacccatttgcaggtgctcttattctcgccaattgcgacagaaaatgaaggatgcactcaaacagtcgatccttcgagggagtatgccaaggcctcgtgcatgtagtgcgattatatatatatatatgtatgtaagcaggccatgccctatagctcttgttctataagcgatggataggcataggaaacgaagaggaccccagtgtaaggaagagtagcaaaaaattagaactagatgactaacactttgctctctatagccgttttgcttttctcgatgctctcgctagcacaagcggagacgcacacgtttaattggaccactggctgggactacaggaacgttgatgggctaaagagccgtcccgtgatcacctgtaatggccagttcccatggccagatataacggtcaacaaaggtgaccgtgtgcaggtttacttgactaacggaatgaacaacaccaatacttctatgcatttccacggtctcttccaaaacggaaccgcctctatggacggtgtgcccttcttgacgcaatgtccaattgcgccaggcagtactatgctttacaatttcacggtggactacaatgtaggcacctactggtaccattcacacacggacggtcaatatgaagacgggatgaaaggtcttttcatcatcaaggatgatagcttcccctacgattacgatgaggaactttctttatcgcttagtgagtggtaccacgacttggtcacggacttgacgaagtcgttcatgagtgtttataatccgacaggtgctgagcccatcccacagaacttgattgttaacaacacgatgaatctgacatgggaagtccagcccgatacgacgtatcttttgagaattgtcaacgtgggtgggttcgtttcgcagtacttttggatcgaggaccacgaaatgactgtggtcgaaatcgacggtatcactaccgagaagaacgtaacggatatgctttacatcactgtcgctcagagatatacagtcctggttcacactaaaaacgacacggacaaaaatttcgccatcatgcagaaatttgatgacaccatgttggatgtcattccaagtgatttacagctgaatgcaacctcttatatggtctacaacaaaaccgctgcgctgcccacacaaaattacgtggattcaattgataacttcttggacgatttctacttgcaaccgtacgagaaagaagccatctatggcgagccagatcatgtgattaccgttgacgttgttatggataacttgaaaaacggtgtgaattacgccttcttcaataatatcacctatactgcaccaaaagttcctactttgatgaccgttttgtcttcaggtgatcaagcaaacaactcctccgaaatctacggctcaaacacgcacactttcatcctagaaaaggatgaaatcgtggagattgtgctaaataaccaggacacaggtacccatcctttccatttacatggtcacgctttccaaaccatccagagagatcgtacatatgatgatgccctaggtgaagttcctcacagtttcgatccggacaaccaccctgccttcccagaatacccaatgagaagagatactttatacgttagaccacaatccaatttcgtcatcaggttcaaagccgataacccaggtgtttggttcttccattgtcatatcgaatggcatttgttgcaaggtttgggtcttgttctcgtggaggatccttttggtatccaagatgctcattcccaacaaatcagtgaaaaccacttagaagtttgccagagttgctctgtggccactgaaggtaacgccgctgccaatacactggatttaactgatttaactggtgaaaatgttcagcatgccttcattcctaccgggtttaccaaaaaaggtattattgccatgacattctcctgctttgccggtattcttggtattatcacaattgcaatttatggtatgatggatatggaagatgcgaccgaaaaggttattcgagacttgcacgtggaccctgaagtcttgctaaatgaggttgatgaaaatgaagagcgtgaggtaaacgaagatcgtcattccactgaaaagcatcaatttttaactaaagccaaacggttcttctaataaaggaagatcatgtattttgcggtttaaccttatttttttttttcggtcaagggttccaaatgcatttgcatgtaaagtgaatgcccttgtcttacttaatattacatagacatatacttaataatctaccacgtttcaaattcaataatgcatgcttcttggcggtttttgacatgagatcctcatctgtcacgaggctgatgtgcatacttttacttttaatcgatgacatgatcagtttcttttgaacaaaaagccgttatgggttgaaaaaaagtgaaaatgataaagtcatcagaaatatatgaaagatataataaattgtcgaagagaaattacgtcgaggaggttgaggaaaataagaatggcaacgacagatatcatatctctagtaaaaaataatttactctatttccaaatgtggacggaagtggaaattttacaagacgatttatcatggaagggaaatagcctgagattactgagaggtcgtccgcctcacaagctgagcaacgatgtagacacagagcatgaaaatagcttgtcatcgccacgcccgctagagttcatattacccatcaatatgtcacagtacaaagagaattttctcactttggaatgcttgagccagacatttactcacttacgtagtccatctactgaaagaatactgctggccataattaacgatgatggtacaattgtttactacttcgtttataaaggagtacgaaaaccgaaaagaaattgaaaaatgaacttaaagacatctttctgcattattttgtttatttttattatatgtatttacaggctaaattatataatgacatcacaacatttccttgctctctaaattgaggatctctttgctccaagttattacttggtctatggacgaagtcatcaattttgttcgacatactattcaataattcacttccaaaggtttgttccagttttgaacggatgcggttaccatcaggtaggcctaactgaacgtaaagatttgcaaggaaaagaaggtcagaggaaagtattacagaatcatccagttttttacgggcagccaaccaattgctgacgcaactctgtagtctattatcaaattggagattatatttcacctgttgtagctcttgcttacccttaattttgttcttatgcgcaattttgaaggtctttgattgtgctagttgcgaggctgactccattgctttactttctacaaattcttcatcatcctcaagggtcagtgagcctataatctcctcacaattttcacgtgcttgcgatcttagttgcaatggcgtattataccacataggaaaatatagcaattttgaaaacaacttcttggtatattcattgtaatttttggtgttcaaaaagagctggtagtccgttagtctagaaatttcaacgtcaacataattcaatagggaatactctaaaaggcgatccttttttccaacaattgctaaatcttcttcataatccgtacctttctcatatttgctagtacatatatttttatgtaagaattgtacgatgttcacgtaaccagatactttcgttccattatctaaaattaacactggtagttttccatctgatgataggtctgtattgtttgagaatacgatctgcaatcccgcaaccatactctttgcctcttctgaagtacataacttgataaaccatacaagcgcaatgctgtccactgaaatcaacgatgcttcgccatcctttccccataaatgcacactacctttaaccattactgactcgataatagccttgctttgcgtttatttgaaaaatacaaattccagcattaaatagtagccattctaaatagcttatttcttattacatttcccacttcgtttaaaatgataacaatcgtgacaaaattgtcggttaccttgtaataattaagaagaaaatgtagcttgtgtgatgaaagagtattctacaacgaaataaaaggccaaactggagagtcaaacaagagatatgtccagctctacgactcctgatttactatatccctctgcggacaaagtcgcagagcctagtgacaatatacatggagatgaactacgacttagagaaaggattaaagacaatcccacgaatattttatcatacttccagcttattcaatatttggaaactcaagagtcatacgctaaggtgagagaagtatacgagcaatttcataacacattcccgttttattcacctgcgtggactttgcaactaaagggtgaattggcaagagatgaatttgagactgttgagaagattttggctcaatgtctttctggcaagttggaaaataatgacctatctctttggtcaacatatttggactacatacgcagaaaaaacaacttaattactggtggacaagaggcgagagctgttattgtcaaggcattccaactagttatgcaaaagtgtgcaatttttgaacccaaatcatcttctttttggaacgaatatctcaattttttagagcagtggaagccattcaacaaatgggaggagcaacagcgaattgacatgctcagggaattctacaagaaaatgctatgtgttccttttgataatctagaaaaaatgtggaatagatacactcaatgggaacaagaaataaattccctaacagccagaaaatttattggcgagttatcagccgaatacatgaaagcccgttccttataccaggaatggttgaacgttactaatggattgaaaagggcatctccaattaatctgcgcacagcaaacaagaaaaacataccacaaccaggtacctcagactcaaacattcagcagttacaaatttggttgaattggataaaatgggaaagggagaataagttgatgcttagtgaagatatgctatcacaaagaatcagttacgtttataaacaaggtattcaatacatgatattttctgctgaaatgtggtacgattattcaatgtatatatctgaaaattcggatcgacaaaatatcttatatactgcgttattagctaatcccgactcaccttctcttacattcaagttatccgaatgctacgaactggataatgattctgaaagtgtttctaactgttttgacaagtgcactcaaactttactatcgcagtataaaaagatcgcctccgatgtaaattcgggtgaagataataacacagagtatgaacaagagctgctatacaaacagagggaaaaattaacattcgtgttttgcgtgtatatgaatacgatgaaaagaatatcaggactatccgcagcacgtactgtatttggtaaatgtcgtaaactgaagcgtatattaacacatgacgtctacgtggaaaatgcatatttagaatttcaaaatcaaaacgattataagactgcttttaaggttttagaattgggtttaaaatacttccaaaacgatggagtttatatcaacaaatacttagattttttaatatttttaaataaggattcgcagatcaaaaccttatttgaaacatcagtggaaaaagtgcaagatttaacccagttgaaggaaatatacaagaaaatgataagttatgaatcgaaattcggtaacttaaacaacgtttattctctagagaaaagatttttcgaacggttcccccaagaaaatttgattgaagttttcacaagtcgttatcaaattcaaaactccaacttaataaagaaattagagttaacttatatgtataatgaggaagaagacagttacttttcttctggaaacggggatggccatcatggctcttacaatatgagttcgtcagatagaaagagactaatggaggaaactggaaacaatggaaacttctccaataagaaattcaaaagagactcagagcttccaacagaggttcttgatttattgagcgttataccaaaacgtcaatattttaatacaaatttactcgatgcgcagaaattggtcaattttttaaatgatcaagtagaaattccaacagttgagagcaccaagtcaggttaacattacgttaataaataggtatatatgaatatttataccaacacatctattataataggcgaatctctgtatgtaattaagtaaaaaaaaacgatgtgacaggatagttaacgtgcctcgtacataaataaaaacggaaatagttaattctttcaaaaatatggcaatagccaaactcattcagaaggtacaggaaacactctgtttctgtgcgtttatataaccatgcttataaaagaaagattgaacaaaatatacatgaatttatgaacggtaatcaccgttaattgttacatattcatgtgataaatcacaagtccaaaattgtgctgcctgatcaccggttcccaagtcgacagacacttccaaatcattcaaagccaatatttcagaagcccttgtttcatcgatctccaattgtggcacaccattagcgacaagcttcagctcacgaggttctgaattgtcggtagcaataaagctaacattaattttgttgacatctagagattttaagtcattcagctttgcatacccgatcgcgcacaatattcttccccaattggcatcttgcccatatagtgcggttttgaccaacatagagttcgagattgattcagcaattattttggcgtcttcaaaatgcaaagcatttttaacgttaacagtaacaaactttgtcgaaccttcaccatcgcgaacgactaactgggccaagcgctgagcaaattctgtgacctgcaattttacttgttcaaaatctttagagtcttcgttaatttctttggtgtcaatagcaccgttggccaacatgcaaattgtgtcattggtgctcatatcaccgtccaccgatatacaattaaatgaacgggtagtagcgaaagtcagcatcttctgcaacgccttgctttcaataggaagatctgtaactatgaaacctaataaggtagccatattcggacaaatcatacccgcgccctttgccatacctgtcaaagtatactcagtaccactaggtaatttgaatctagatgtaactaattttgggaaagtatcagtagtacagattgatttggctacgttcaaccaagagttaaaatcactgccgaacttttcttctccaaaaattttattgataccagtgctgatcttgtccatctgtagtcgttgtccaataacgcctgtagacatgactagggtggaatttttttgaccaattttatcgttaaccaaatcaatcattacttgggcatctttcataccaagatcacctgtgactgagttagcacaaccggaattgactacaatagcgttaatatttttaccacgagcagtttcaaggacttttttcgatgtcaaaactggcgcagctttgaatttattagttgtgaaaacagctgctgcggttgaaggacgagatttattggtattcaagattacacccaggtccaggctcccgttttttttgactccagatgcagtgtagcctacttcaaatcctttaggaaaagagcccgtcttgggcacgtataatgcatacttatctataagctgcttcgagcgttgaagcaatgttgatgatattctcatgctatgttgaattttggacttctttaaataaagggaatagaagtgttgctgatactagcccaaaaatcgtcacctttgtgcggcgagccgaggatgaggcttttatatactcgacgactaaagaagttggcaacgaattacgcagtgagtcatcctacctgtccatcgcagtagaaaaagaccttcgccaagaaaacaccgtcaataatgattgctaagcactctcacttagtactactatcaacgctaccttcaatttgggtctaaccacggccctattgcatcactactctctttattctatgatacagcgtgggggtgaagccaagagccctgtgttttacttcagcataccaacaaagtataagattacttttgctatacagcgatgaaaaatgtattttaatgtttgtaaatttatgatctactgacacgtctcagacagatcacatttacaacacagcatgctatgactatatacaaaacatgacttttctttatcactaaaagtaactgccaatttattgtcgaatctcgctatagtttgattttcaccagcggcgcgcgcaagtataagctaagaaacaatgaatatagatagatagtgatgagcgttgagaaccgggaaatgagtagagacgtccttctaaacaaagatttatacggttgagacagattcattgaggaaaagaggagaatggttagcatgatccatattgtggtgtttttgctagcaatcacaaccatgttcgaaatacttccgctaataaccgtccccgtgaccaagtacctatcgttatcgtcattcagaaaccactattatggcctgtttggctggtgtgtacgtggtcaaaaccaagaattgatgtgcacgaaaatgaagataggatatgacagtacagatgtcgactcctccgggcacgttttgaccctgccatcgaactcaaaagtggtcgtctccaatttattagtggttcacccgatttcactggcattcacaggaacgctattaattttagcagtgattatcatggtaactccactaggggactcacctgagatgttattgttcacggcccttttttcgctgccaacgttcatgctatgtcttttatgttttttggtagatattcttctgttcatctccaaactggactggcccggctggctaatgctagccgctactattagcgtagcactttgttgttccatgctgtgggtcatgagaagagttgtgtcagtcaaaaaatatgaatcgcaacagtcaattgcgcatgcgtgctcaatggaacagtactcaatttccgacatttaccagagtaaacagaacggcaatagctcagaatatgaagtggctccaacacatacagatagtctgattgctccagaagtgacatatagagggttcattgaataagtaacatcatgtgtcattttgcacgttgcatcggtttgccaatcggcttccaaatatttgtacatttttttcttcctccatcactatctgttaagggtcttagaaaatgattactacagtgcaagaaatcagcaaatggagaaacctgtgcttcattaggatgcaatctcgcaaatggtacccagtacttaaaaagactcctttagtagcggacggtcgaaagatcattaaacatgccgataaagttccccatccgggagaaataattcacccattttaccaaccaacagcaatagaacaattcacggcatgcgctacggaatacaatcctagcctgcttgatggcaaaaaaattgctccatcactgataaaacacccggtgagcctaaaaaccatactagttgatagcaaattaaagtttgatgatattaggggagtgaatagatggttgatggaatttgttgcaagacgacaacatcaaagaaatattgtacttacgcctgcgagcaaaagcgttagatcttttcacgttctgcatttgtcttcaaccgatattgccaaattaagaggtcttgaaaatgtattatcagagattgaaaacacgaatgatttgcaatccagggtcgagtccgtgaataatgaactacagaatatttttgaccgcgacagtaaacagacaagattattttgcgaggatatactggcttatttgataaagaattatggaaactcgactgaaaaccttatactactaataaatgttactgagatgcaattattttcacgtttagaccaaatgaaggccatgaacattattttatatcatatcctttgtaaagtggaagcaaatgaaaacccaccatacagtcccacattggttaccgcactagaaaacctattggcagcgatcaacaacagattttttccagggcgttgcgaaaattcattgcacccaatagtaattgaacaactattatcatatttcattataaccggcaatttgaatgaaagcaaaaattttctaggccatttaataaaaaagggtattttaccagaggctactatcattaatagatatttggaggcaattgatgttcatttcgataaaagcactaagatctttgatataagatccaaatttgcattcatagcagatcttgcacccataatagaaaattatggaacaatagacctgtttaaatttttgatacctatgtgccggcatttcgacgaattgtgttctctgctaaatattattcgaaaatccaataacgcaaaacaggctgtggatagcaccttacctatttttatcaaaaaagtattaacatttactaaagatccaatgatcaactccggaaatctatccactgttttcaatatagtgagcccaatatatggacaaaacgtgcccagcgaattcgtggagaaatttatactgtcttttgcacttcaaggaaattacactatgatggctcatatgatagatacatataagatcaaactaagtcataaataccaactacaaattattagggctctcaaaaatagtgagagaaatcacgcgcttaagaatacgggcgctgtaggttataataaggaatttaaaaagtacttcatcgagaaatatttgaattgcactgaacgagaagctttacgcccataaatcgtctatattaaaaaaaggcagcataagagcaactcactgcaaagggaattgcgcattccacgcaaataaacaatgtaaataagaatacgtactgtaactgtgtcacactagcgggttgttttatcataattgtttgggattaatcctgaacaaattttctatatataaacactggttcggaataccaatgaagtatacatattctggttcaacaactgtttctattcaaaaactttgaatgtttgaaatgcgctacgtctatttgtttgcaatttgtattaagtttgtttcaagctccgaactaggaaaaatcaacaatctgctgcaaggaagattgatatacacagataattccgttgcgacaaatgtattagaatccaaatttccattcttgaaatcaacatgtgttaaagacgcactaaaattatttttgccacaatgtattgcaaatggacttgaatccattgacgctgaaacaagggtagaaacggccattaaactttcaatatgcgagtttcaggcatctggcttgggcgaaataccagaaaattgcatggttgacgacctaggatcaatgatggattgtatgtttgaactagaatcatcttcacagtggtggacaacttatagtggaaattatcagcgactatcgagtatttgttatgaaaatcttcttccttttgaaaaagaacagatactgaaactttttttaaatatcactgaactttatgattcatttggggatgatgtcgatactaagttaaatcatctgatgtttcaaatggagcaagattctcaaaattttttggacgatctggccaggatgttccgcaactatgacaatgaactgcgaaatgcgaccgaaagcaatcgaataatcttagaaaacgacctctcattttttagaaataaagtgaatgatgtactctatgaaacttccgaacaactagaggtccaaatcatagagaagaacagtcaactaatgaatgaagttgataccgtccatcatattatgagcgatctagccgatgagcttgctaaaaatgacataaaatctaagataaatgacttgaaggacgacagcctgaataatttacaggacctagtggaaatgtccaacgacgtaaaagaatattactctagaaataacaagttagttaataccgagttggaaaacttctcgatgggtttaaaaaaacagttaggaggcatgtcaaaggatctttctgaatcacaaatggaagctatagagctcttgcaagggttcaattccatccttcatgattcattgttaccatccatgacagatgagatagtacctgagatgacgaacttcaaaaataccttactacaagaatggacagctataacatctacactaaatggagattttgctttatggaatgaggagattttttcaacttttaatgatatttcagagaagctgaatggcacaaaaaaaaaattagacgacattgaaatcagagtctcacttgtccataaaaatgtcatgacaatgatgagggtattggattttatgtggaaaactagtaaaatgattataagatgtgggtaccttgcagtcaagaataaatactactggttactgtgctccgttgtgtggatttggtcaaaataccgtacgtctcgagtaaacgtcaaaatgattcctattaaacgctattaccaatgggcagctcttctactttcaatttatctaggagctaagactggctcattgattgatttttaacattaccgatgtaacaatatatgaaagcctatatatacatagatgtataggtatataaccgcattcaaagtctagcaaagtaaatattctttaaaaattcaaggacaccggatcatggtggccataatacgggcaagtgaacctagagaaggtgtcctacgtcactatccaagttaatttgcttaagagagtttgagtgcagcacctacagctttatcattgaagacgaagcaaaaagatcttgagattctatatcatgggcacaggtagtattcatgaggtagtagtaacgtattaaacaaggccatactatatttataactcatgttcaaatacaaccgctcactctgtagcagcgctttgatagcaaagtctcagattcgtttttatagattgaagcgggcgccattgaattatgcctcccatatacctgaagttcttaataagaccatcatagggccagacgaaccagaaaaatgtctcattttgaaaggaaaaacatcagaggaaatcgaaaataatcttctcagtaataagaaatttcaggagatcaatcctcttgatactatccaggaaacgttcattcaatatctgaaattttgtaatgaaactaattttaaaagaagtaacaagaatttaaacagattaaaaaaaaccttagaaagcaaggactctaatagcaccgtaaaaattaatgcagttttcaattatttgctggaagagtgtgatttagaaatcaaaagattgaacacgaccggccaaacccaggtatacaatgaagagaaaggaaatgaagatgacttagagcaatccataatgaacgatattttccgatcagcacaagaacaatttgaagatcaagagggccatataccgttaaggagtacatcatttttactggagattttgaaaagttttaatgaacggtttaatggcataatcaaaccgaaagagtcaataacagaaatggtcacattcagccaacttgctcaagcttttgaagttgttaaattgataccagtgcaagaaatgaaagaaaaagggatttacttggtcggaaatttactttatggcacagggaaagttcgtttagatcctataaatgagtcattctatattgaatccctactagtttttggaaactataaggctgcatacagtttatttattaccaataaagacaaagtaaacgagcgctggtggaacgaactaggattaatgatcacattaaggtctaaccacttgagaaacttcaggaaacttttagccgagacagatgcaaagtactcaacaaagtattcttatttgagcccaagaattgccaaattgagcatacgaaaatatttgtcgattggcattgttactgaagctaatatactgactgatcgatttattaagttagtggaagaagttggaataatcagaatgaaagatgagcaggaggaacttcccacgggagttaaaaattttcagaatgagaaacatgcaactgagttcttaaatgaactagaaataccatcggatcatgattatatcagcattgttgatttccatctttataagagaaatattcccatggcggctcaacttatcagcaagtacatggaaatacctggaacgacacaagaagatgccgcatttctacttgttaaaaccaagctaaatatgttgaaagattttgaaaagctacgaaacatttttgctcaaaataaagattatgtagtgcctgagaataatgtgaaaatgttgcaagaggcatttgagagcgttattactaagtataacactaattctccaatatacaatgaattgctgtttgagaatgtttcggccttaacaaaaagtattgtattaactgattttctggaagagtttattactaaacaggcttctggacagtggatggaattaaacagtgtgtcacgttccagaaagtttaatggcttgttgaacatacttctcggtacaggtgaagaagaaaaagcatataatatcttaaaaaaactagaagaagcctcaaagaaatcaaaaacggatccgggtttactctataatcagttttattcggaagttaatgcatatcattacgctaaatttgttgaattttatagtcttcaaattcaaaatatgaaggcacaaaatacgccctcatttagaaaaaaggaatttaagcagaaagtgaagtcacttttaaaaagaatgcaggagtcagaggttatcccaaatgctgtttttttgagagaaatactcaatttttatgatagcatgtatgactttaattcaagttttgagatcatcaatccgctacttgaatccaaacaacaggtgagctctgagtcttcattatccacctcaaacccttgccgattttacaaccgtcgcatcataacaaaaccgctgtaccacaagatttggtctgtgtattgccattattatcatgttttacaaaataattctaggattttatcgaaaaagtcgtccattgtaaagaaattaataaaaaggcagataaagattcacccaacttgtcacccaagagtattgttccaaatgacgacagaaaatggtgaaattttgccagacaaaactttttctaaattaattgtgtccacgttcatgaaaagcggggatttagaagcaatacctgccatattaacgtttctaacaaaaaaatttgacttgaatattgattacgatttgagtatgtatattctaaagggtttgaaaagacaatatttacgagatattagtaacatcagtaaagatgcttgtgagtacaagttacggaaggcggagctaatgaataatgagtcaatcttaaaaaacattccacagggtacaaatcaagagaatacaatatcccatttgatcagggagattttgatctttataaaatggaaggaaaaaagtgattgttctactttcttgatggtagaagatgcttttaaagaattaggaacagagtttactttactcgaagaattaatagaagatgtaaataagttaaagataaaagcctaaaaaaacggatgcattttatataattttagctatacgtgtacatatttgtaataaagttaaaagaggagactgtttagctttgtatttattttttacttaatttcatccatttaggtactctatttaaagtctttttgatacttgtagcgttatcagaagggccctgtggattggatttatttatcgtattaactgatggggttgtcctcgtttcgtgtgtgattttttgtgcgtcttccaaaagatgagcctttattaatgggccattagaatttgaatttgtttcaaaaagcagcattgttttagagccaaattccaggtcatccagtagcttcttatcgtctttagccaagggtttgaaaggatgagattggtttaacgtaaaaggcatgttctcatcgatcaggaactgcgacacgacgttataaactgtacgcatgtcttcattgggtttgaatgctatttgaatatggcttctatcggggaacttgactctcagcaaacactcagatatagccttatttttctttggcaagttgttggctgattgctctctaagtctctttgtcaaaataggaccacccaaagtaccagccttcgatgataacattttttggtatttcttggcttgttctactgtcaattcataatcttcttcatcctcgatttgatccttgataactgctaatggctcatccgagggcaaaaacacagaaggtttatgtagttcgtgaggtggtagtgaagcaaccgtttccgggttcgtcatcgtagggggagtttgttttgggtgaatagcgctattagcgctaatgccctcagaatgagatgtattattaaaaatcaatctaactgacgaaggctcctgaatccctaaattttcgagagtcaaattctcatccttaattgttttgaactctattatcttggaaaagacctggatcttaaaatcatctcccgcagcgccgctcatctgtcgcaagataggggcaattggttggtcagatggcatttctttaaccacggaatctcttcctgggatttgaaaccgtattttgatcgtattgaatggaatatcttcgcggttggtcttattcgccaccggaaaattactacttttagataattctaagttgacacccgttggtaagtttagaagcctccatggcaaatctaatggcaccggtttatccaaatgtatcaatgaccagtcgtttgacgaggtgtgcagttgaaagaattgtatggattggtgtaacacatcgtttagtgttgaattcaacgaaactttacatttgaaaagttggaagttatacttcacggtaaccataggcattgtattgtgcgcttattagtctgccttgctattcttcgcagtacgtagatttatcttagtttttgcattttttggttttctttttttttgtccacacatagtacaataaaagagaacttgaatctttgaagaaacgtctaaattaacatcgaagatagaagacagggaaacatctaggattgcaagaaatagtgctgaaattttgtaataaagttgcaagaaatagcatctagcgttttataaggcgtacatctttcttggcaagagttccaagagaaaagaggagcaaaacagcggttgaggcgcccgctatcttgaatattatacagtttctttaaaaacgcttgtacaacactgcataaacatggacaaattattgaaattgtttcaagatatttcccatatcatattccaatagcgttactctctcatcgcttattctggaatcattattttaataaagataactcacacgatatacgtgtactgagctgacctttatacctacccttacctgcttattcctgataaaaatgttcgtgcaactaattgtttgatttctcttgcggcccggttattccggagttgatactttttttcttctgtcttaattacgtttttttcctctagacttttttgatctggtacaattgaaaatgtataaattaactggaccctaaaaataaaaaaaaacgcccattagaaaagaggatatattgaacaaaagatgttgaaagagccctcagttcgcttgcgggaggctattattgaaggcaatctacttatagtgaaaagattattgcgacggaatccggatttgctaaccaacatagactcagagaacggatggagttcattacattacgcctcataccatggaagataccttatatgcgtgtatttaattcagctggggcacgacaagcatgaactaataaaaacctttaaaggaaacacctgtgtgcatttagcattaatgaaagggcacgagcaaaccttacatttacttttgcaacaatttccgcgatttatcaaccatcgcggagagaatggtagagcccccatccatatagcatgtatgaacgattactaccaatgtctgagtctgttgataggagttggtgctgatttatgggtaatggacactaatggcgacacgccgctgcatgtatgcctggagtatggcagtataagttgtatgaagatgcttctcaatgaaggtgaggtgtccttggatgataatgtcagggacaagggaaattggaagccaatagatgtagcacaaacgtttgaagtaggtaatatatattcaaaagtgttaaaagaggtgaaaaagaaggggccaccgttgggtgcaggcaaaaaaccaagttcattcagaactcctatactaaatgcgaaggccactttcgaggacgggccttccccagttttaagcatgaattcgccatattcgctctattccaataatagtccgttgccggtattaccaagaaggatatcaacgcatacaacaagcggtaacggtgggaatcggaggagttctatcacaaatccagtattcaacccacgaaaaccaaccttgtctacggacagtttttcgtcaagctcaaattccagctcgagactaagagtgaactccatcaacgtcaagactccagtaggtgtgtcgcccaagaaagagcttgtatctgaatcagtacgacacagtgcaacaccaacaagtccgcacaacaacatcgcgttgattaatagatacttgttgcctaacaagagcaatgacaacgtgagaggagactcacagacagctacaatcaacgatgacggtggcggcggcaatggcggtgatgccactataggaatgggactaagaaaggacccggacgatgagaacgagaacaagtacaagattaaggtaaacaatggcgagccgaggagacgagtgtcacttctgaacatacccatctcaaaattaagaaatagcaataacacgcgtgcagaagattgagaagactactacgtatttttttttatatgcatccttttttccacatatgtatgcgcggtgcgcgcgcgccattaaaagatttttttcttagctctttttcttttttctttttctttccactgagatgcgttcttcggtatatagtgagaacacttacaactgtatacgaacatcgaaggagcacctaacagaaagaaggagggtcgccatggcgccaatgttccaacatttcttaaacttatgcgtggaaaaatttcctgaatccatcgagcacaaggatacagatggaaacggtaacttcaccaccgctattttagaaagggagattatctacatccccgaagatgacactgacagtattgacagcgttgacagcctcaagtgtataaactacaagctgcacaaatctcgcggcgaccaagtgctggacgcctgtgtgcaattgatagacaagcacctgggcgccaagtatcgccgggcctcgcgcattatgtacggcaacaggaaaccatggaaggcaaacaaactcgcagagatgaaaagcgccggccttgtgtatgtctgttactgggacaacggcgtgctaggtgcatttacttcattcatgcttacagaggagacgggtctcgtcgaaggtgacgctttacacgaggttagcgtgcccgtgatatacctttacgaagtacatgtagctagcgcgcaccgcgggcatggaatcggtcggcggctactggagcatgcactgtgcgatggcgtagctcgacacacccgccgcatgtgcgacaatttcttcggtgtagcactcaccgtattcagtgataacactcgggcccggcgactatatgaggcgcttgggttctaccgcgctccgggatcacccgcaccagcatcacccacaattcgtcacacgcgacatggtgggggacgtgtagtcgtgccctgcgatccgctttattacgtatattgccttcacatgccgtgaaagccgacagggacaacgcgcgataaaaaaaaattaaaagtaaaactacgtacgcggcggcgcgactcgaatccttgactccgactgaggagacccgaacaacgctccctgctctccgccttcggcgccttccgataactgcgcacggcaaggagtagtggcgataacggtgtttattgccggttttttcgtttttcttcttgattttcttcttttttttcctcaaaagatgtgctgtagcctccgctgttgtttttttttatcctaccaaggcgcatcatcctgtcatgatctgcgctggatagtatttatactactactccgtctggatttactaaactttgtctctcttttgatgtaaagttaaagaagaattacgaaaaaagagagaaaaaatagaaacaaataataggaattaaggccttgtagcaatcaaaaaaaaagaaaaaaaggaattttttttggaagaaaacttgaacaaaacaattcctcaagaaggaacaggtacaagaaaagatttaacagaaggaaaactaataggcaacagtaggcaaatagtaaagggacatatcatatttgagcaatgaatgcggaccatcacctgcaacagcagcagcaacagcgacaacagcatcaacaacaacagcatcaacaacaacagcatcagcatcagcatcaacagcagcagcacacgatattacaaaatgtgtcgaacactaacaatatcggcagcgattcgctggcgtcacagcctttcaacacgactactgtttcctctaacaaggacgacgttatggtgaactctggggcaagagaacttccaatgcccttacatcagcagcagtatatatacccttactatcagtatacaagtaataacagtaaaaacaataatgtgacggctggtaacaatatgtctgcgtcgccgattgtccataacaacagcaacaacagcaacaacagcaacaacagcaatatttctgcttctgattacactgtcgcaaacaacagtactagcaataataacaataataataataataacaacaataataacaataatattcacccaaaccagtttgctgcggccgcaaatatgaactcaaatgctgcagcggctgcttattactccttccccactgcgaatatgccaataccgcaacaggatcaacaatatatgttcaatcctgcttcatacataagccattactattcagcagttaacagcaataacaatggtaataacgccgctaacaatggcagcaacaactcttctcactcagccccagccccggcccccggtccaccccatcaccatcatagtaatacacacaacaacctcaacaatggtggtgctgtaaatacaaacaacgctcctcagcaccatccaacgataataacggatcaatttcaattccaactacaacaaaacccttctccaaatttgaatctcaatattaacccggcacaacctctgcatctacctcctggttggaaaataaacactatgccgcaaccacgtcctacgacagcacctaaccatccccctgcgccggtgccttcttcgaaccctgtggcctcgaacttggttcctgccccatcatcagaccataaatatatccatcaatgccaattttgtgagaagtctttcaaaagaaaatcatggttgaaaaggcacctattgtcacactcgcaacaaagacattttctatgcccttggtgcttaagcaggcagaagagaaaagataatcttttacagcatatgaaactcaagcatacaaattatttattagacgaactcaagaaaaacaacatcatctttaactacaacaattcttcctcctctaataataacaacgacaataataataataacagcaatagcgctagcggcagtggcggtgccggtgccgcggcggcagcagcaacagctcccgaaaatgaagatggaaacggttacgatacaaacatcaagactttaatcaatgatggtgtactgaataaggacgacgttaaacgtgttttgaataaccttattgttagtcacaacaaatagatagactttatagacacacaaaatatcccttcctactcatttaacaatcaagataatagtaataatcacaaatttagaaagtaattatgcatatatacattatatacatatagtttatgtatggtacggaactgattacaacatctctctaacaacggcctcgtgagggaaatcgtcatctgtaggatttttgataatgttcgtattctggaactcttggtgtttagtatatgctaccgcataactgattgacgatatcgttagcccgacagctaccacaattagactcgtagccatcactgcaatggaaatatactggattatcgccattgctagatagaaaagacatctccatccatttgtttcaaatctcttgatgaattcaatgaaattatcgctaaggggacagattttcaacaaaaatggtatttcaatgaataggatcactaacccttggattatactaatgataccaaaagctatcaccccactaacgtggaacagattcgctatcccgagtgcaatacacaagattatgttgatatatccaaaccatctaccatatacgctaaagttgaaacttttcaaatccttcaccataccacccacattgatgaactgtcctaaacttaaagccattttattgaaaactagtatattttagttgttattgctcttctcctggtgacctacaatcccacttcactagtaggggaattctggatctttactttgctgatatagcaccttttttcttttttttttctttttgccttttttacgagccacagactttcctcctttaccctactattcgtagccgtctttttttgttgtttttttttttgtgaaacaacgtagcaagaaagggatcctcatccaaactaggataaacaagtaaacagattaacaaagaagccaatcaattacaacaacaaataaatgaacagttacagcctattaactagatctttccacgaatcttctaagcctcttttcaatttggctagcaccttgttgaaggcttccaagagaacgcagcttagaaatgaattgataaaacagggtcctaaaaggcccacatctgcttatttcttatatttgcaagaccacagaagtcaattcgttaaggaaaatccaaccttacgtcctgctgaaatcagcaagattgccggtgaaaagtggcaaaatttagaggctgatataaaggaaaaatacatttctgaaagaaaaaagttgtattctgaataccaaaaggcgaagaaggagtttgacgaaaaacttcctccaaagaaaccagcaggacccttcattaagtatgccaatgaagttcgttcgcaagtttttgcacaacatcctgacaagtctcaattggatctaatgaaaattatcggagataaatggcaatccttggatcaaagcattaaggacaaatacatacaagagtacaaaaaagctatccaagaatataatgctcgctaccctctcaactagaccgcggtactctcacaatgttttttatgcctttattctttccgttcctatccaaataaataaataaatttaacttaaccaagcaagtgtgtagtgtttttatatcctatgtaagtcttcaaacttttattttatctctggtaacctttattcgcatacaacgccaatgaaacaaacctgtaataatttttcatagttaacccattgatgatacttattaaaatatgtaatcaaatcgtcactattacggtgctttaataagatgtccgtaccacctggatggaacttcaaataactagaaatgtcatagactttgccgtttataacgcaccataactcgtcctcacctttacaatgcttctttacgatttttctgtttattcttaagggtggcattattttataaaggggtatcttttggacaagcaattggttcttcagttgtgaaggtgaaaacttgaagttatctttttgaaataccggatcatcgagtaaatcctggataagctgtagcgaaacgaattttgtataataattcgctggattggaggttagagagtgccagtccagagcactgtgcccaggatctagtcttattttggttcttacaagaggctttcttgatgacttcgacatgggcatatgcagcggggatgatatggtaggatgagcaacgcttagtcgctgaggagcagcgaatctgacatttggtttcgagtttgaaacatctctgttcatgccgtcactactcatatctgtatgggtgtaatctaagcacctgctaatatgttatattctgcttattcgtccttttgctacacataattaatgtaactttaactctagttctataaaggatatgatttgtactaaatgtaacattatacgaaaaaacatattattcgtttatataaactaatcaaagaagtcgtcatcatcttcgtcgtcatcatttttagcattctgcttgtcaaatgaattcagatcttcgctgaaatctttccgttcgaagataatcttactgttattttgtgaattttgttgcttggcgataccattcaagattgaaacaatttcagcttcagtgattttatgagtgacgttgtttgtagcaatcagtttctttaagtatgtctctactgcttgggccctgtctctacggaccaaggccactcgagataatctttctaaagcttgtggctccaagaaatttgcaatagctgcaccaacgggagcggaattttcacctccaccattattagcaccgctatttctatcgccgttggtacccccactgttgtttttcaactgagccaatctggcttctctaatagcttgtaactctgggtccatatctgagcacacacttcctcctgaattgtaatccagagagcaagaagatttttcaacttttactcttggttctccttgtagaaccacaaagtggtataaaaattctcgcttacccagcccaaaaattctcatctgtttctcatctgtttctcgtccgaataagtttcccgttcgcagctaggatttcacctgctcaccataataggcaactttcttcctcatgtaggaaattatactattgctctctgttgcaaggttatttttgagccttaataccatattagtagatataaatacatatatatcgtgttaacccataagtggtagttttagtagctcgctgcaagatctgcctcattcctttgtagagaacgacgtacccactacgcgtttgaacatttgcaacaagcacgagaggaaggaagaagaataccaagtataaacgagaataatcaccatagaaaaacctataaaagacacttccattaccatctgctaataataatacaatggacaccagcaagaaagatactactaggtcgccctcacattccaacagttcttctccttcatcttcttctctctcttcatcttcttccaaagagaaaaaacgtcctaagagactatcctcccagaatgtaaattacgatttgaaaaggagaaagatcatcacttctgaaggtatagaaagatcattcaagaacgagcatagcaatcttgcagttgaagacaatatcccggaagaagaacccaaggaacttcttgaaaaggactccaagggtaatatcatcaaacttaatgagccatccaccatctcggaagattcaaaggtatctgtcactggattgccgttaaataaaggtccttctgaaaaaatcaagcgagagtctctttggaattatagaaaaaatttgggaggccaatcgaacaactcagaaatgacgctggtccccagtaaaagatttactcaggtgtcgaaaaattttcaggatttgaacagaaatgatttgaaaacgtttttaactgagaacatgactgaagagagcaatatacggtcaactattggttggaatggtgatataataaacagaactcgtgaccgtgaacctgaaagcgaccgcgataataaaaagctatcaaatattagaaccaaaataatactttcaacgaatgctacctatgattcaaaaagtaaactatttggccaaaattccatcaagtcaacatcgaatgcgagtgaaaaaattttcagggacaagaacaattcaaccatagattttgagaatgaagatttttgttcggcttgtaatcagtcaggttcttttttatgctgtgatacatgccccaaatcctttcactttctttgcttagacccaccaattgatccgaacaacctgcctaaaggtgattggcattgtaatgaatgtaagtttaaaatcttcataaataactcaatggcaactttaaaaaaaattgaatccaacttcattaagcaaaataacaacgtcaagatttttgctaaattacttttcaatatcgattcccacaacccaaaacagttccagctaccaaattatataaaagaaacctttcctgctgtgaaaacgggttcgagaggacaatactctgatgagaatgataagattccattaactgatagacaattgtttaacacttcttatggccaaagcataactaaattggactcttacaacccggatacacatatagattcaaattcaggtaagtttttaatttgttacaaatgcaatcaaaccagactaggttcatggtctcatccagaaaattcaagattaataatgacttgtgattattgtcagactccatggcatttggattgtgtaccgagggcttctttcaagaacttaggttcaaaatggaaatgtcctctacattccccaactaaagtttacaaaaagatacaccattgtcaagaagataatagcgtaaattataaggtgtggaaaaaacaacgattgataaacaagaaaaaccaactttattatgaacctttacaaaaaataggctaccaaaataacgggaacattcaaatcataccaacaactagtcatacagattatgatttcaatcaagatttcaaaattacacaaatagatgaaaattccattaaatatgatttttttgataaaatttacaaatcaaaaatggttcaaaaaagaaaactctttcaatttcaagaaagtttaatagataagttagtatcaaatggatcccaaaatggcaatagcgaggataatatggtcaaagacatagcctctttaatatatttccaagttagcaacaacgacaagagtagtaacaataaatcggcttccaaaagcaataacttaagaaaattatgggatttgaaagaactgactaacgtagtcgtgccgaacgaactagattctatacaattcaatgacttttccagcgatgaaataaagcatctgttatatttaaagaagattatcgaatccaaaccaaaggaagaactgttaaaatttttaaacatagaaaatcccgaaaaccaatccgaatagaaacggcgtacatacataaagaataaatcaggaacgtgaacaccttccttacatatatacacacatacataggcatatgtatcgcatcttaaagtgagagatctacctattttccttttttttccatttacaacatagcaattgatgtttttttcccttctaagtcatctcgatgtcatcatcttcatcgtctttgtagtcaacttctttcctgaccctcaatttcttcatcacaatattttcgtgccctttcttggtttcatttttgttagacggtgaataactgtcatcatcactgtctgattctcgatccccatcaccttcttcgtcgtcagcctgtgatctcgcatgatgaactttcttctttttttttgtgattcattgttttcgtgagctaataacctcttttgaagcctttgtctttgagtttgtgacgtgtgaagaatccgtccgattttagcttttatattgttttgtattttttcagtcaagctctctggtatgtatgttttgaaagataactgggcctcctgaaccgttgcaaaaggtttgaacaaatctgatggtaagtttaatttacctggatatgctgaatgttgccaatttttcttctcttttaaattcaatagaatcatttgcgacagctcacctatgatatacattttctgaccgtaaggtctatgcttctttggcgcttcttctttttgtggtccttcttcttcatcaatttcatcctcaactaacttatcttgatagttttttaccctttctgataaataatagagcaaactgaagttctcttgggcggcaatagagtcaaagtaaaacagcaaataatcaatcgctgttgttaaagcatttagatatgcgtctccttcggaatctaaacctcccacaatatcagggtgatgtgcaatcgcatgtatcaacctaggcaaagctctttcaaatatcgtcccttttttaaatgattttaagccaaatgtaaagtttatccatatcttcgttgtggttttcagttcgacatctggttcataagcagtaaaaaatactagtggtaggaactttatggaaatcagttcattagcaacataatctttcagttgttccaaaaatgtttttcttactggcagcgattcatcttcaaccaaattaattaatttaataatgtccgaaggtttgataaagttgttcaaattagaaatcctggccagttttaaaacttgaattcctgccacacacctcaattttgtttgataattactgggggtgggataaaactccttgttaaactcggaaatcagctcaccaccacttgcaatcaagtaaaagaataacttcatagttttttcggtgaaactttctgccaattcatctcgtggaacatccggagcaattgatctcaatttgttggtgaacagctttaaagtaaacaccttattacctattgcagaatatttcgtgtcacttaatagagaatcttctacccagtcaatttctttttttgaatcaccaacgacctggtttgataatagaacttctttaattaggtatgatatgatatcagtggaatcatcatttaggacgtgagggaattttttaaatatttccatgagtacaataatatgagatgtaaaatacttgtctttttgcaaatctaaaggtaggatacgtatttttatctttttcagagtttcttcagctttgggcgataaagcgataagttttgtggcgtatttcgttatttctggtttactttcaactgcaaaatcgtataatttggtgaagaaaaacgtgtcgtcaaaatccacttgatcctttaatgttttggaagccttgtaaagggtttttaaagcttcttccaatgacaagttatcatttttttctgcatctggatcatccaaatccttgataatggtttttaatgttctaatctgatctttaaataatgtgggattgactttcgatatatcatccaagattcttcttttcaaatccaattgttttgcgtcagaattattagataggttcaataaaacactgatgttggatacattataaattattggtgaggctctaaaaagcaaaatttgtattaccttggcgatatcacgtggcataatggaagcaccagtagatatattatattttttaaatagtcctggcgtttgtaacttactgaccaattcattgtaacaatttttaaaagtaagaaacggaatatcgttggtgacacaggcatttaataaataaaagattctttcgtcgttaaattgttttattgtttcgagggcgtcgattgctttcgtagagtcagaaaggccagaagctaaccactggagagtttggttgtacttgttcattacaataggaccttgagacgagctcatactttcttgattgttcaaaaatttactaaaatcaatatatttggatatagcgaaggatattttgatttgtcttgcattgaaagcgaaaaatgaagtgaatgccttcttatcaaaatgtgacaaaaccgttagcagtctgtggactcttttatcgttatctggttcaaacggtagtaggtattcgaaaattacgctgtcgacttgttcattgatgtttaaatcattgatataatagagattgtataaagtggatggtatggtgtctatgatttcccaaatttctttattttggtatgtcctttcgatctcattcaatgaatttgagtaaaacttggccatagtgttaatgcagagttccctaacctccttatgtttttctcgggccaaatgaagtaaagatgtataaatggctttattggttatatttttccaaatttcagtaacgggaactttattaaaaatcataacagaagtcctgcgtacacgaggatcagaatcaataaaggtttttgccagtgcctgattcagttctttggatatgtcttctctcgtggcaatgatttgaggaattgattctgtccattctactctaacatcgggactaatatcagcaattttggaaatccatgccttgaacgtatcggaatgtgtagaaacaaaatttaaatccgaatatgaggtaagtatttgaccaattaattttgtagcttcttttctgaaaagctcgttttccgaagataattcgtggtatataaatccgattactgcattgatcagttcgggtactgtttcccaaagtctcaataccagtttatgtaatttcactaccacagtgagaagtcttgaattattgtcatcattagttgcttcatgaataatctcggaatagtatttagttagatgtctactcattctattggaataagtatcacacaaaattagactaacttcgtagccacagtcagaagtaacgttcaaaccttcaggaatttcattcgggttataggtcaaaaacttattaaaaattaatcttagtacttctaggggaacagaatcgaactcagagatgacttcaccgagaataccgcctattacattgaagagccttgcggggaagctcttgttaggatcgtaaaaaatatggaatagttcgataagtaaattgtttgaactaggtaaatcggctaataatacgattgatctgtattctagtagcttagtgatcaaataagtttgttggatgtgatagccgttttcttggtcacctaattgttcaaattgtgagagcaccagcttgaaaatgtccgttagttgagcatccgtataaggcgcatctggagcatataatctcaggatatcgcttagacaacaagcggtgaaagcgcggatccccacgtctttatgttttaataattttctgctaactagtgcgtccctatatttatctaatcccgttaaatctgtattgtcttgatccagagaggctaattcctcatgtaaagcttttaaacgatctaatagttcatttgttgatatcagctgatcggaggtagatattataggtgagttaaacttcagtttagtaacagcacctttagccattttgttcgcactttatttcttgcttctttacaaatatacctgtaaaaattgagaccggatacaaactaacaaggtggataaacttcttttaggtctttttacaattaacaacaatttcgatggagcctaggtttataaactttcacttgtttatacaactttacgcgtcgcgtcgcgacatgtctatagattaagtcacttttaacgccatcattccgggtagtgcatattttcccttggcggctaaatagatgaaaaggtaaaagtttaatctgagaaaaaaactgcattgaggagtctgaaaactgaggataaaacaaacagtcgcagttgagttgttctttttcatggaaattcttactatgtactgcatttaggaggggagttcatcacactattataaattaaaatatacatcctgcttcttactaaattatgtttttaactattcttactgccgcaattccaagagggtagagggtaacttcagagtctttacctaaaaggtgggacgccagacgggcgttaaaaaactttccgtaacggctgagataaaaatgatttcgcccaggatcgaactggggacgttctgcgtgttaagcagatgccataaccgactagaccacgaaacctgttatttgtgatggtctggacctatacttatggttttatggactaaacattttatgtaatcttttatagaagaacatttcttttttcaggtcaaccgtacaggaaactttcctctaataataggatcttttttaatgtagctctcaatatatggcctaaatatcatgtcctattctttttttgaaatatctccgacatttaacaaaatagtattatttcatggcatgaccattgaaaattgtgcaagaactttaatttaggaaagttcattgattcaggataaatatataaagaaaaagccactatccccagaaattttgctgttgatgaaggctacgatgctgtgaattcagattataggagaaattcacctcgaggacttgaaatccacattaaggaatcgatatttttacacgataatattataactttttcctctattttgtttttcttttaatatattgtcattcatcattttatttcaagcaaaatttaaaggttaacataaattaatagttgccataattgggacagaaacttccattacatctctagacttttctcaatctttatatcatctttttatgtcgtatatgataatcttctagtagtatggaacaagtcaagagatgatagctgatgcttcattttaacaataaaaattctaacgactatttatcacgtcttggcttagctataaaagtactatataaacttagtatttatttttgaaaatactaaacaaattctatcaacgaaaaacctggaaggaacctatttacattccctttatttttaattttgaagctacatacagacattcaggatagtaatgctaaaggttccttagtgtctgatctctcctccgtcgcgaattcctctctttctttttgctcggtttgttctccttgaggcaatgatggcaaaccttctgttgatggcatgttagctacttttgcgttattcatcttctctggattgagttcactttctagagcatccaattccttatctagatcgtcttcataattgcttgttccgactaagcttctagataatgtctcgttaatttcattttgatacgcaatttgatcttgtacatcgtccatcagttcatcaacattgctaaattccttgtttagttttttcaagatttcatttccatttttcagtccattaataaattgcttttctaccattttgaactcaagtgttgacaccatattttccaaattaataagctgatccgaagcctgctgcaacaaatgctcctgataatgaattctttttagtagaaatcgtaccttcatgttagatttataattttcaggattttttcgtattaggtcttttagttgactcttctctaccaaaatcaaattatctgtcctcctcgtaaacttatgaatttcatctttagatcgttttacttctaggatcgccctatctgttttggttatatgcactttactacttttttggcccattcgatatatacaaaagcaccaagtggagttaattcagcagtctgtactatttttccaaactatctatgttttgttcttttctatgcgctatattgtatcccacagatagtaattcgattttcggtctttctgctcttcggggttccatttatgtagaaataagaacgatagcgaagagggtaaaagatcacgaataaaaaacgaacgctgcgtgacaaaatcggagctgttgcgactaccggcaggattgattgctaatgttctttatttacttcttttagatttctatgtaagctgctggtccatatacaagtatgcttcttaagagagactgcgtatatatcttacgtcatttattcccacaggttattccaagtcacatttttcctgacagcgttagagaacccctcattgtatttcacccatattttaaccgtttgattgcagtcatctgcttggttggtttcgtctgatccaatagttttttgtgtctcttccaattcctgagtttgcttcaataatccgtactgattcttgaaaaagtcgattgtacttgaggaagaatttaacccagttttgacttttttgctatgcatttcctgtgactgtagtctatcctcagtcacttggtctatatgccttttcttggcccggttttcctcaatctttgctaacagtgaactcaaattattagcccgtttatgttggacttcgttaatatgtttaggatttaacaatacgacttcatcgattgggggatcgattgttaggccaccccttacatcaaatccttctgaccgattttggattagattcagttgaaagcttttcagcaattgaactaattcctccatgatggcttgtttgagtttcaggttccttattttattaaaatcggaagagatcatcgaatctagatatggtagtatttcaaagattaacgattttctatccgtaaaacttgccattagtggggactgaaccgagatatgtctcataatcagactaactatatctgaattggctcgttttaattcacgttgttcgtattcactattcttcattctaatatcatctttgtttgcgatatcgccaaacgtttggaagaagactaggggcacaagggcggagtaacgtaacaattcgccattatgcgcatacattgattggtacattaaatcatggaaaaatagccaatctgaaatgtttgctggctttcttataccattgtcggaatattttacgtagggaaatatattaaaacagccttgcaatatcctgtcagagttaccattaagctctacttggtttagcaattcataaaactgctcctttatatcacgatgtggatcctttctaaacaattggttcacgattttaaaccatgatatgggggagtccttgttggatgacgcccacgtattttttgcacaagcaggtttatctgatgcagaggaatctcttgaatcaacattcgaggccaagaattgtaaattgtttatacaattccttacgtcaccttgagccaaatcaattaagtcattgattgcttttataggaatattcatgttttctttatggcagataaggttcaatcgctctagtagggtagtatcggaaggtcttttcacagcaataatttcacagaatggtttcagcttttccaaagaaggagcatatagattattgcaaatacaaataataggtcgcgtaagcaatttagaccttttctttttgcgctttttgtcctttttatctggttgaccgtataatagtttattagtggctttaatatcgctttgcataatgtcaactaaaattctaataaatccactctcaatacttccatcaatctcatccgccactaagcacacaggatttgtatcgaaagtatgattgaataaaagattatatattttctcttttaccataggtccagccctttcatcacttgcattgatttctgagacagaaaaccctgattgtttggcaataacgtgagctactgaggttttgcctattcctggtggcccgtgcagtagtaaaattttctttggtggccttttcaatggatcgagttccatatcactgacctctttttcggttggcaatttgggtaattgctctttaaacacagccggcgtccattgtctcaaccaacctaacattctcctgtttgtcttttcattaccaaccaaatctagaaattttttaggacgccatttctctacccagagtgtgtcgctacctatcttgccagttataggtgaagtcttttgtgcgttagtgcggtcatcgccagatgcctcaattttgtctaacaaatagtttatattgatgccgtacgtgtcgtctgatctccaaacagtatctgggttagtgtatagactaatattcccggttgctaacttcgcaggcttcttctttaattgaaccgtttcgccagtacttgatacaaacgcgtgaatatcttcctcattaataccaattgcattattaccaggggcttgttctatatcaccagtatcaaaaagggaacttctccctagtgaaccaatgtatggtgcggtatcaaccatgatccctgaccttacatccaccttttgggtcaaatagtgtacacattaggaataaaatatatgaaatcatgtttatttacgtgttagatgttccgtacaacgcgactggctagttcgttttttccacattttttttttcaacgttgatcaacaataaaatggtacatcttcctttgtttgtgtcttaagtgtcctttcctggtatatcgcttgaccagcgcctgtagcatcaaaccaaaccttcatcgccctaaaacacaatggttacagtatgttgttgcttttatttactttttctttttttgacattcattgtgacaatattcacattcttcagatagttctgtctatatgaagcaaaaatgatatatcaataagtttactaacaaacacaagtggtattactatgacttcactttaaatagcaacaagaaaaggaatttttagaatcctaccctcaaaactgtcctccagatgccttgcctggtactccaggaaatttagacagcgctcaagagaaggcattggcagaactaagaaaacttttggaagacgctggtttcattgaacgtttagacgattcaactttactacgttttttgagagccagaaaatttgatgttcaattggctaaagaaatgtttgaaaactgcgaaaaatggaggaaggattatggtaccgacactatcttgcaagattttcattatgatgaaaaaccattgattgccaaattctacccacaatattatcataaaaccgataaagatggccgcccagtatattttgaagaattaggtgctgttaacttacatgaaatgaacaaggttacctctgaagagaggatgttgaaaaacttggtttgggaatacgaatctgtcgttcaatacagattacctgcctgttcaagagctgctggtcacctagtggaaacttcatgtacaattatggatttgaaaggtatctccatatctagtgcatacagtgttatgtcatatgttagggaagcctcctacataagtcaaaactattaccccgaacgtatgggtaaattttacatcatcaacgcgccattcggtttctctaccgcatttaggctatttaaacctttcttggatccagtcactgtttcaaagatttttatcttgggttcttcttaccagaaggaattattaaagcaaattccagctgaaaacttaccagtcaaatttggcggtaagtctgaagttgatgaatccaagggtgggttatacctatccgatatcggtccatggagggatccaaagtatattggaccggaaggtgaagctccggaagccttttcgatgaaatgatattatttttaaagacatttttttttcgagagagaaaagaggagttctaagtaacgatattttacaactgagataagtacaagtatgcttatttactctattctacttttttgaataggcatagttcacacttttatctccttagtttgtactactctttttttatttttttttttcttccactcagctattagattatttattattttattatctgtggtatcattttctacagccataccttgattttagtttattttgttggcagttatatacatttatcttatagaatacatatgcacgtattaaacaataaaaagaacataagcaaaaatgaaacctcgctacaataaaactttattacgcattgcagtgcgccgtaaagagtattcattagaagtacaatggtagccctatttggttgcaacatgttttagcaaagagattagtaggctaggatatcaagtccatgcccctttatcacatactgtaatgatagatgcacctccggaaaagtaaaaaaagtttttcaggttacaattgtgcaaattgcgagtctatctcgaataattttgcagcgctcatttcacggttgagccgttttgtatcacaagccaagtttaacattttattttaacagggttcaccgaattatattcccaaattgctgaagtcttttgacaattcatgcttttgttcttctctctgtaactctctcgcgaagttagagttcaaatgagaagcctcctcctggtacaaatttctatcgtcaatttcattgcgattttgcttttgagaaaaagcacttttaaaattctcaaaattccaatattcattattgatgtaagaagaaagttctgtgttgtcaacaaatgcattaccaaagtccccaatttgaccactgaatgacaccatactctgtgcatcaaaatcctggaacttcggaaagtcacccatttcagattctacgttaaattgagcgttcattggccgttcagtctttcttggctgaggacgaactaattgaacagtgcataactgtaagttatccaacgtaccttcgactaaacaacccttctctctgaagtggattaacagatggttccataatgtgtttcttgccaaagatctaggattaccaagaataactagaccatatttggcacgggttagacccacgtttagacgacgaggatcacgtaagaaaccaatggcctgttgttcattggcacgaacacacgataagattatgtaatccttttcacgaccttggaatgcatcaactgaggcaacttccactttgatatacaaatccttatccaatgaaccattcatttgcatatattgtaaaatataagctctttgtccctcatatggtgtgataacaccaatttgctcgggcttgacaccgtctctgaaaagtttagtgatgattcgttcacaattcatggcttcaattctgtttaagaaggaagtaccgttagcagaaatctcctctctaccgtaattggcccaaaacatcattggtataccgcgaattggccatgggaatttgctgttgggaacggtacgctgttcaatcgttacaccattttgtaggctgccttcataaaacatgttacttggaaactcactcaaataaggattcatacggtattgaacttccaaacgaatcggtacgtggcctagagagattaatctttcaaagagagattgtttcaaaccagcgtctgccgcctttcgttccaatatgactgggcccagttgctggtgatcaccaacaagtataacttgtttcgcacctttaacgattgggattaaacattccggctcagaagcttgagtactttcatcaattaacacagtcctaaatttagtgtctaagcgcttatcaccagcaccaacacatgtgcaacatacgacatctgccttattgagaatttctgcttctgttttccttactaatttaacaaaccgttttgtatcagaagcagataattcgccaacttcatcctttaactttaataggttttttaattcccctttagcaccacggccaaccaaattatgcaatgctaagttggagacggaactctccacatcttctctacttttcgcggtaagtctaacaacttttaaacccaagtcacgtaatttggcagccaaatgatctacagcaacgtttgatggggcacacaccaatattctatccttgtgtattttggaaaggtgatacacaatcgttgctgaagtaactgttttaccagtgcctggtgggccttgaattaaagataacggacgttgtaatacatgactaacagcgttcgactgggatgagtttaattgtgcaaaattcggaattgaaaactccttaggtaatgggacatcaaatgaaatgtcaaccacttgatggcctaaaattttatagtacaaataacctgaaatagattttttatcaatggcaaattttttcaatgcgtcttgcatcctgtcataagaggtacctttccagatgaactcagcagtaaaaccagtggtcaaatgtgttggaggtggcgttttacttggttttaactctaatgtgaatgtgtcctggaagctatttggtaaccgaacaatgtaaccacgaccttcccaatcaggatgttgcatgccagagtaccatagtatcatttcatcaccgatggcaactttcaactcgttagattcgaaagtagataaagtgaaagatgctaaatgcctattatttaaagctaaggaccatgaaacagaaatatgttctaaagcttgagattccttgagttgtttatcatagtcggcctccaatttgattaaaggcccgtaagatctttggtattcgtaggcgtcttgatatctcaatagtaaaggtgggattgcttcctgttcctctggggcgtcaatatcattaattgtagcgtctttattggatctccattttgcctccaacttggaaatttggctaggagtgattaaacgagctttcaatttttcttcttcagttggttgctctgcgacccatgataaaagttgtctgtcttcaattaatggttgccattgatcagtatcccagttcgcatttttcgtctgggcacaaggtattctacaaagtaaaacaaccacggcctcacttttagcggaaacaaatcccaataaaaacacgttcttacgtccacagttataacattccaaaacggtatcccctaagtcagaatctggatgtaaagaaactacgttatggtgggataaaactaagtgattaacaatgtgggagctgcttgtaccgtttttagtgttacaaaaccatttcttacatgaattacatttgatgacacactttgcagaatctataccacaatacgcacatgaattgtctgaagctgaaggcgaacggaatccagtctcagtgacttgagcctcttcaaatagctgattatctacatcgtcatcctccaccaaggtggaatttagttgtgttgcgggttggacatttacatcagatggagagtttgatatatcataaggagtgtgagaaccggaaccgaccatttgataatgacaatgattgatgtaatataaaaagtatattcggtcttgctgcccttccttctttcctgatgaaatcttcaacgtttgttggctgacaagagaaatagagtcttctgttagtgtgcgttaaaacgatgcctcttttcgctttttttttctccttcacaatagcatcgtaagtttctggtaagcttttcatttgatcagttagtacgaaagcgtataaaggtgtccctcccaaatcaagtaagcaaagggaaactgatgatactaaaataatgtaaattaagattaaactaaagttaaaagtaaaagcattcactcgtttaatattattgagtggatagtaactaactatgtatattttctttttgtttttcttatttcccgttcatgaattcattaaaagttaggcgaattacggagttcgccagatgcatatgtttcgttttcaattggagaatgaactcgctagtgacaattttatgaatgattttctcctgggattcctttcctccaggcaattagaagtgtgaggactagattcttcgttagaagaagccacactagtattcaatgaactattggaaggagatttcaccaaagagttggaatacgagttgtttctagtctgcaagggagaggaagaggaaccattggaaagaagcgaaaaggattctcttcttagatttgatggcgttcgttctctgtgatagtggttaaggtttccactgtgacctgggacgttatttgatgatattttcccatgggaaatcaattttagtcgattattcttttcgttggagagataagacgacggatatgcagccgaacttgaattcagattcaaatacgagttggaattcgaggcgggtgttgaaacagatgttaatggggaagtgagatcatttgactggtcgttagctactgctagagagtctagctcggatgaaacgtatttttcaaggccgtatagatgtgttggtataccgtaacaggaagaatgcctggatcttggctttatgcatttgtggtcaaaacaggaatccgccgcgtcgcccaaggaagactgtcttgtggattgtctggacaactggtgaatgagggtgctactatttgctcttattcttcttggagaagggcgaattggttcattggaattgttcgttgaatttgctgggacgaagccatacaagtgatgcggagctgtcttgatttttctcaaatggtggccaatagtatgattgcctatgtgtctgcttgtattaccggcattggtactgctgctgtggtgagaattatttgatttcgaggaattttgaaaactaaaggacgctaatttggaatttacaaaatcattcaaatcatttgaacctaaaaaactttgtacgtctgtttcatcttcataatcacaatcttgacaaaatggatcttgtacacctctttcaaaaatttctgaagcaatcatcaaaatacagcgactatttctattctttgatgttttttattccactgaggagataattattcaaactgaaatattttacgcaaacctttctatttatgtgtattacctttaatctaagtggttgtagctcatacacttattataattggtagagaaagaagaaaagaaaaaaagacaaatttaagtagacttgaataaaagtaagatagaaagagatgtgagattttcagatgtttgcttacagaaaaaacaagagttcttaaacatcaagaaatcggtaaaagtgtaattgtatttataatagtgagtttcggaacttaaaaatccgtttccccgtcaagagaagcaaagatcagttcatatagtgatttcccttaaaaagttaccacagcttctgaattaactgtaatccttatctactagtatcaaccaacccttgtgtttttttttttcacacttcctctaggaaaaaatccaggagtaagacggcgtttttttcaaattttctttctccagtttttccatgctgggtttcttttcgttaatagtggtgggtaaaagaaaacgtacgaataaaatgctgaatgtagaacatactgtaggctcattaatacacagtagaacgcagacccattcgaggggctcattggaaacacgtagtcgacattagttctagataatccgcttgatgggccacatatggtaatggcttctcgaagcagatgttacgagccgccagaacgaggcggtggcatctgcctcgcgctgttttctagcggcagagaaaacccgtagatatgtttctaatgcgcgtgtgcggggaatttcgttgtcacgttgttttggtaagttccttcgctttctcgtaaaaataagtaaaaatccggggaaactattatttgcggttcgaaataaaagcattttaatttccttccttggcacatttcttggccacggatgacctaaaacattgccaaataaaaaggggtaagagaacttttgtcttatagttatttcagcgatagtcattcttccagtttctgttttgtaggacaaggggattgctgcttagataatcagtgccgcaagaaatctcagatgtggggccaaaggtaaaaaataaaaaataaaactgaaagataaaaaataaaaaaaagatcgtctcacgtacatcgtatctgctcgagtgaaatcactgtatggtaaaaatgtattatgcatctcttgttagcattaaatgagcgtaaagccgcatttgtgtaggtggactatcattgataaggaattcaacttgatttgagtcatattcttccgaatgatttctggtttagttttaagttttcccttttgccccgctaggatctagtttgtctattcaaattacagtgcatgaaagttaacttcgaattgatagggatgcgtcgctacgctcacgggacagctcataaacacaaggagcttaatgagctgcaacgctaaaaaggggtagaatgattaaaaaaaaatcttggacagcgggccactgataccacggtagggaccaaatacttccagaagctttcgtgagatacgaaacattactatagttttactgcatgtttacaaggcaaacattaaactttaatagcaaaaagtcatttttttgtggattttaaatgcaacgttgctcctcacctgcatcttgtaagctctaagttttgattgagcatatttataatgttgctacgagttatttattcgggaactttatggtctcggagcgacaattttgttatcataatgtcatattataatgtgatacatcgtctgaagaagagaatgctttcgaaaaattcaccttaacgctatgatcgaggtttgctaactcagggtaaataaatattacatttgtgatatttcggcggttgtgcctcttttactactttacaattagttacaatttctttttcttgagttacttttcctcaaaaagaaaaaaaaaagaagaaaggcaaacctaaactaacttatgataatatagaaatattcaaagctaaataaaagtaattctggtcttgaccaaccgtgatgttcaaaatcactcgaccaattttcactacgtcgtcctgacagcccatagatgggataccagttcattagtccaaggagtagcttccttcaagattttcttttttaagtagtaaatccatatcaagaagtgttatgaaacatattattggaggcatgcactattacctaacgtcgccatatgcgctcgtatcgattgtatcgattgttacgggttctcttccacccctgtagcgctgtctgtgaagctttcttattacacatctccgcgttcattgacgtcaatctttttagaagggatcctgatcacgaaggaacgcatagtgcatcgcttaacctggctagttggttgcaaaggaatgctatttttaaatactagcgtcttgcaaataaacaatcggatatgaaaacaatatgacgtattatatcggctcgtattaattacattatactgatttttaaaggaatcatatagcatgggtctttgcacaatgcattacgtgggagcacatccctttgaaacgcacccacgcatttgctaaagaaaaagaaagtaataaaataaaagagggcaaaagaaagaaggacaagagaaattcttcgccacggcattgaatctatttctccttacgaaaaaaaagatcaaggaaacatgtcggaaacaaatgggaaacaacaaaaaggacttatcattcctacttttttgtcgagggcatttgtcgagggtaatactgcatactgcctattgtcggtcccgcagaattaatagtggctgctcatacacaacgaaaaaaattgttaacaaaatagaaggattcgtctatgcccttttttcagtgcggaaattatataccacacaagccgtcgaagcccatagggtcctttaacaataaagactctcctaaaaaaatttttcttgtgacacgtcagtgcaggatataaatgtagcaagcgtatataacaaatgacaaagggttcttgcgcaaggttactttagcgttgctggataatgatcggattgtttttagatcacgatagcacatttgaggaatcgtatcgaaacggacagggcaagagtacgagggcgaaatgaacttataacaccattgatattttctcctcaatcttatcattccacgcacattattttcctactatgttatgcgggaacagttcctaaggaatttttctaatggcatttcggcagcgtcatcaaatgtacgcacccacttcaagtgatcattcgctcgttactacctatcacgtgtcgcatcactcgcgacgtccatgcgcatgctgtgccgcaggagaattcgagatgcgaatgagcagcagccattttgatgttgtgagcatcggaacgtttctgcgtccgtacactgtccttttgttacttagataatggctaaggcaagcagtccgggccacaggagtcaaaggcttttcgccagctcctaaacgctggaagtgtaattttttttcgtcttataaaattaaacaaacccttttagaaaggaacactcgctttatctcttcgaccgaatttactatacatggatatatatatattatcttctgttcacagttaaaactaggaatagtatagtcataagttaacaccatcatgttgagaacgtcaacattgttcaccaggcgtgtccaaccaagcctattttctagaaacattcttagattgcaatccacagctgcaatccctaagactcaaaaaggtgtcatcttttatgagaataaggggaagctgcattacaaagatatccctgtccccgagcctaagccaaatgaaattttaatcaacgttaaatattctggtgtatgtcacaccgatttacatgcttggcacggcgattggccattacctgttaaactaccattagtaggtggtcatgaaggtgctggtgtagttgtcaaactaggttccaatgtcaagggctggaaagtcggtgatttagcaggtatcaaatggctgaacggttcttgtatgacatgcgaattctgtgaatcaggtcatgaatcaaattgtccagatgctgatttatctggttacactcatgatggttctttccaacaatttgcgaccgctgatgctattcaagccgccaaaattcaacagggtaccgacttggccgaagtagccccaatattatgtgctggtgttactgtatataaagcactaaaagaggcagacttgaaagctggtgactgggttgccatctctggtgctgcaggtggcttgggttccttggccgttcaatatgcaactgcgatgggttacagagttctaggtattgatgcaggtgaggaaaaggaaaaacttttcaagaaattggggggtgaagtattcatcgactttactaaaacaaagaatatggtttctgacattcaagaagctaccaaaggtggccctcatggtgtcattaacgtttccgtttctgaagccgctatttctctatctacggaatatgttagaccatgtggtaccgtcgttttggttggtttgcccgctaacgcctacgttaaatcagaggtattctctcatgtggtgaagtccatcaatatcaagggttcttatgttggtaacagagctgatacgagagaagccttagacttctttagcagaggtttgatcaaatcaccaatcaaaattgttggattatctgaattaccaaaggtttatgacttgatggaaaagggcaagattttgggtagatacgtcgtcgatactagtaaataatagcgtgttacgcacccaaactttttatgaaagtctttgtttataatgatgaggtttataaatatatagtggagcaaagattaatcactaaatcaagaagcagtaccagtattttttctatatcaagtagtgataatggaaatagcccaaatttggcttccgtcgacacatagaacgtttgagagacattatcaccatcaagcatcgagccgcccaaacctaaccgtataagttttttcacgtttttgatttttccttgcacacttcgatattactctcacgataaaagggccgaagagaatatttttcttgaacatccagaattttaattcggagaaatttcacaagccgccaatttaagggtcctgtgttcttaataatcagcctctctcaaagcaggtaagaggcagtctttcttttaacaatgagagacattcgaactaaaacatcagccccaaaaatgcgcttgaaggtcattagaatttggatttcttcctcatttttaaaggcgccccttttcgttttagtcatgctgggctacactagcacgtagtgtatggaatcaaactgatgccgtcccctgaattatatttacaattcagaaacgtctttgaacatttataattaaattataaaacaaaaggaatttgtaaaaaagactttcaaaagatgatccaatcaactagattaaaaacccaatataagaagaagaatgtgtggcatttttggctattgcaattttttaattgggaagacaagaggagaaatcatcgacactttaatcgaagggttacaggcattggagtacaaggaatatgactccagtggaatttcgatccaaggtgatgagctgaagtctctcaatatttataagcaaaccggtaaaataagcagtttgaaggaagaaatcgacctttacaatcttaataagaacctgccctttatttcgcattgtggcattgcccatactaggcgggcaacacatggagggctaagacgtgcaaattgtcatccacataactcagatccatctaatgaatttgttgtggtacacaacggggttattaccaacttcgctaatttgaaagccttattggtggcaaagggctatgtgttcaaaagtgacactgataccgaatgtattcctaaactgtacaaacacatttatgatacaagcattgaactcgggtacaacctcgatttccatgtattaacaaatttagtacttaaagaattggaaggctcttatggcctgctatgcacttcttctcattttcccgatgaagtggttgccgcaagaaagggttccccgttagttattggtgttaaaggtaaaactgacatggacgtaaactttgtcgaggtggaatatttggatcaagaagaagactacttgaagcttaatacccaaaccaagagttctggtaatgtcttggctgccgcacctgtaaaatataacacttgtttaaggaagtcacccccccttcgttcacaatacctgagaaactctacaacttctacattcaatcatggctcatccacagaaacgccagccgagaacggcttgccgcgacccatggaattctatttgtcatccgattgtgcatcactagcgcggtatgtgagtaaagtagtatatttggaggataatgatattgcccatatctatgacggggagcttcatatccattgctctaaaattggttccgaggacttttcatttagaacagttcaaaaattagaattggagttgtccaaaatcaaaaaaggcccttacgataattttatgcaaaaggaaatatacgagcagtgtgaaacaacaaaaaatgtcatgagaggaagagttgacgcctttacaaacagagtagttttgggaggactagaaaattggttgacagaattgagaagagcaaaacgaataataatgattgcatccaagtcctccttccattcatgcctagctgcccgtcccatctttgaggagttaatggaagttccagtaaacgtcgaattggccttggattttgttgaccgcaattgttgcattttcaggaacgatgtttgcatatttgtttctcgaagtggggagacaactgatacaattaatgctttgaattactgtatcaaaaaagaggctgtcacaatcggggtagttaattgcagcggttcctctatctcaagatttacacattgcggtgttcatacaaacacaggccccgagaaaggtattgcaacaaccaagtcttatacttctcaatacatcgctttagtcatgattgccctatggatgtcggaagatttggtgtctaaaatagaaaggaggaaagaaataattcaagccttaactataatcccaagccaaataaaagaagttttggagcttgaaccattgattattgaattgtgtgacaagaaactaaaacagcatgatacatttttgcttttaggaagaggttaccaatttgcctctgctttggaaggcgcctcgaagatgaaagaaatttcttacgtgcattctgaaagtattcttaccgacgagctaggacacagagtcttagctgtggcatctgataatccgccaattatcgcctttgcgacaaaggatgctttttcgcccaaaattgcgtcttgcattgaccaaataatagaaaggaagggcaatccgattatcatttgtaacaaggggcataagatatgggagcaagacaaacaaaaaggaaacgttgttacacttgaggtaccccaaaccgtagattgtctccaagggatacttaacgttattcctttacaattaatttcttactggttagcgatcaagaaagacatcggagttgatttgccaagggactcggcgatgtcggccccggatatataaaaaagtgttctttaatttcttctaatctcattaaaacaagtacttatattttgagcagtatgtagaatagatgttcacactctatagccaaataacttaattaatggtcaaggtaatctcttgcaattggtgtcactgccacatcttttaacgtcaacagtaaatccgcaaaatcccgtcgcgtcgccgctaagcaggcccaattttagctcactgcggcagcgggctggccgtgtggcgcgagggtcaacatgcaaaaaaggacgatagataaccttaaaggaagtattcatttcttcgctaaattttcagtgctcccttactttaccgacaaattggatagaaacatataaaacacaacagcaacacgtagccataccaaccaattccacaaatcaccagccgttcgttcctaaaaatgtttagaagaagaacaactgcaccagaaatggaacaggcggacccgacagcagtggcagctgcagcaagtatcggtaaattatttatgaagaagggtaatcaatctgataacgaacaaaggccgacctatcgatccgcttcgatgacaaacttaagaaaaccttctgcccccaaaagaatgtcttccatttctagtatatcatcggaatctagaaggtgcgatggtaaaggtcgtcccgggaaaataaacagccttacccaacggtcatcaatggggaagggagattcattaaattctcctttaacgaaggaaccgcagcacaaagctaggtctcataatagaacttcgagtctccctaaccagagaggtcagcaaagcagaaacagttctggtttacaacgtcaaaagtccaaaacacaccaaagaataagctatgatgaggctcaacgtacgttcaaggattttggcggaccacaggccagaggaattttaacgggacaacaccgtactgaaaaccctagcgggtctattcctttgaggactacgcgaaagtatattcctgggcccaacgggctggttgcaattgaggtccccgttgaaaaaccaagcaatgccaatacttctaaatcgctaaggcgttccaactctgcccacagtgccttgaatgcaagaaatagttcacttttaagaaaaaaagtatcgcaggaatctttacattctcaaccaaagaagacttcgtctttagggaatacatcaagtacacaagctaaaaaaggccagaaggcggttcaggagagaaatcttgccaagaaacatccaataaattcaaatgttcctctcattgaaacacaagttcgtgaagaaacagaccaagagttgaaacttgataattctaactcttccgaatccgaaacagtagtcaatagcgaaaataatctagaaaaaccttcttcactaaacattgaaaaagatgatctaagcaaactgatacatgaaaacattgagttagaaagttttattgaagaaaaagggaaggaaaaacctttaaattctgatcaagaagatgttttcataagcgaaaaaactgtaaaaggcgatgtacaatggccaaaaaataaccgtcaagcatctactcttgagaaaacttttaattacgacaacgaagagaagagggaggggaataaaccagtagcagaacatcctcttccggaggccgaagtggatgacaagtcggttgaacaactgaacaacatttcttctagcggcagttattcggcccaaggatcagttgaaaactccaaaccagaaaatggcaataaaaatctagagaatgacacaacatcgtctcccacacaagaccttgatgaaaaatcccgctcaatagaagagaaggataccttggaagggaccgagagttcaaaaaaagttgaaaagccagacaattgttgtgagaaaatctctggtgctaatacttcttccaaaaaagggaatgttggcgatactaaggatgaattcttcgatacagtagaagaaagcgatcagaaaacgagcaagtcgaattcctccaagaacaccgatcaccctaatcaaacagaaccaacgccttctttggctcagtatttaaggacctcaaatacctacctttctcgaaaaaaccaatcgaaacaagctgagcaagaaaagtttcacaagcctgaagctcctatggttcctgtaacgaaagtagttacaccaatcaaatctgctcttaaaaaatcgtcaggatcatccaaccatgactcatccatgtactctgataactctcccgccaatggcgcatatctgtctcttacgactgctgaaaatacgagattaaatgctcaaatgacgatgtccgacagcgtatcacgcagagcaagtgtaaaacgatcttctataaaaagacctcagtcagtaggccagttcagaagcatcagatcaaattcgccttctcctccagagaaaataaacaataaacgccattctgctatacccctaggaaccccagagaagggtaaaccaaaaagaaattcggttatggcttctctgtctaaaaattcgcagcaaattcaagagcccgcaagtgtatatgagtcaaatggcccaaataaacctaaaaaccaaatcaataagaatataaagagaggatcacagatcgcgcaaaacaataaaccttcaacgaaggacatgaatagtattttgtaccccaaagaaccacctcctcgcaaatctagttttgagaagacgagaagcaatgaatcccatctcggatttaaaaagctttctttgagaaatggtaattttgaggaggcattgagtgaaagctataatgggcaagctagccagaatagcacaaatgtgaatcgaaccgatacagcacaggagtttttcaaatatttgggtcattcatcaagatttgcggattcagactcagaagatgagtcccaatttttcaaccaaggcccatcaaaatacaacacagaaacagaaggcaataaaaccagcggtaacaaaaatagtaatggtggtaacggtgctttttcgcttttcaagagcaaaagtaagcaaaaagaaaataatgtggtttcccctggagtctcaagtcctaatcatactaccaccgatcctgccattacaagtaaaaaggtggacaagaaattcagcggattatctttaagagctgccagtgaagctgaacctgcaaaaaattcaaacccttcgatgaccaataggttacgcttctctagtaatccagagaacggcgaaagcaggctcccacaagcacaggaagtcagcgttacaaaagaaaagaagggtagtttcggcaaaaaactgaaaaaaatctttggtagaaagaaatagggactctcggcagaaattctctccttgtacaagttatgtattttattctttttcgtgctcgttcaacttctgaacgatggcttccatgcactgtaacatataagggattttttaataatgaataatcaagaaatctccattttatatgctttttttttttgccgtttccactgcaatcaatggcgatataatcggatgaacaataaatattcgtgttcctattcgtgttcctatacgtgttcctagtagcaaacaataacagaagagaagcatttgattttcgtaaaaaattcaggtgtgggtgtttcttattaacggttaaactttacgaattgaatcccctatgtataatggtccataatacatcttaaaccaccaagccatcttcgtaattttgaactgggaaaattggaaaaactgcagacattcataatcatgacaggatctttaaacagacactcacttttgaacggggtaaaaaaaatgagaataatattatgcgatacaaacgaagtagttaccaatctctggcagaaatctataccccatgcatatattcaaaatgataagtatctttgtattcatcatgggcaccttcaatctcttatggattcaatgcgtaaaggtgatgcaatccatcatggccactcttacgcaattgtttcacctggtaactcgtatggctatcttggaggagggttcgataaagctttgtataattattttgggggaaagccctttgagacatggttcaggaatcagcttggaggaagatatcacacggttggatctgcaacagtggttgacctacagcgatgtcttgaggagaaaacaattgaatgtagagatggtattaggtatattattcatgttccgaccgttgtcgccccatcagctcctatatttaatccgcagaatcccctcaagacagggtttgaaccggttttcaacgccatgtggaacgctttgatgcattctccaaaagacattgatggtcttattattcctggattatgtactgggtatgcaggtgtaccacccattatcagttgcaagagtatggcctttgcgttaagactatatatggcgggagatcacataagcaaagaattgaaaaatgtgctgatcatgtattatttgcaatatccgtttgaaccttttttcccggaaagttgcaaaacagagtgccaaaaactaggaatagatatcgaaatgctgaaatcctttaatgtagaaaaagatgcaatagaattgctcattcctagaaggattttgaccttgaatttataaaggtatataatataaagtctattttcaatttttcaagaacttgaactacgtttgtaagtatgtttcaccagatataacgataaaacaattcccactgctgccagggctatatttggaatataggaaatcaggaatgcctttttgtagacatcaagaatgcgaacaaatatatccgttggaaaattgggccctctcaagtaactcgaatcattgataagggagtagtactgctttttggtgaagtgatattcgtcatcacgcttggttttgaacatataattccataacatggacgacaggctattctcataggacactaaagttaaagaggcaccaagaacgttaccaatggatctccacaaatagaaaacaccagtcatggttccttgctgtgatttttcgacggtgaatacgatgcttactaacgtggccactaatagacaagcgtaaccaaaggacacaaggactgatgcaaacacataaatcaatttccaccatattgagttagatctgaatgtaatagactcaagcatatcatatatggtgtagtcaggattcaaatgtgaaagtagcaaatagcccaaccccaaacccaatagctgcattatcataccaccaaaaatgatttgatatgcacagtgtgctaggttaattttcgtattccgcaatacccatcctgttaccaatgatccgactgcaactgatatagaggggaaaatcaaaaagagaccagtctttgttacactaatattttgaagcaattgtaaatagattggcgacctaaagatttcaccaaatacaacaaatgaagatataaccgttaccgctgagctcaaacagaatgaacgagtcaatagttcgaatggtaaaattttctcagtcgcgtaataacgttcaaccaggataaaaacaataaaactaccaatggtaaacaatgataaatacaacttgttcaactggctagagcacaaaaataaaactccactaatggtcgccaccagacttaatgagccaaatatatctatccgtgacagattctttaaggtatatctttctttcataggaggaacatggaatagcttaatattaatgtttttgattgctaataccgagcacaacattatcacgggtacttggataccaaaaagagccctccatccaatggtttctataaatacaccacccaacggagcacctagtaattgaccaaacccgaaaacaatattcgcatatccctggtaaacgcccctttctcttgctgtacatatgtcactaacagcaatgctactaatagcgttcaatcctcctgcaccaataccacatatggctcttgctattgagaattccgtgacgtttctggcaaaacatgttaataagcacccaaggccaaaaaaaaattgagcggttaataatgctgacttccgccctgttatatcagaaagcttcccatatagtggttggaaagccgtatttgtcaaaagaaaactcgtcgcaatccattgctttttacttgattcagagaattcctcagcaactctattcattatatttgcgacaatagtgctatccaaggaactcaaaaaactacccaaccatagcgaaaacaaaatgggaaacttaggtaaagccaaattgtattcatgaaatttttgttccaagggaggggcttcagcttcctcaggtggagggagtagatttgaagtctcgtctagtgtttgcattcttcttgttccctcaacaactagggctctgagcttagtgaagaacaaagaggagacaaaaaacaaaataattcgatagaaaaaaatcgctgctgtattcttatattttgggaatgtgggttggcctaaagtggaaccgcatgctcttctctatcaccggcccttaagatgacctacgtttattgtcggatagatatcatccaacaaaacgacgcagtgaaaaagtgtatcatgcgaatactgaagataagataggctaagccgtggaatcagcgataaaaaaaagatcgcgtgtattaaccaatgacagcctcacagaagcgctttgatcatatatagatataggtgcatttatacacgtatatatatttacatgttttcagattagattatatggtaaatacgtgacagtgttctaccgaaaaagaaagatgtctggctttcaataaaataagcaagatatgtagaacagtcttcctccatttctttgtattgtgaaatatcaatcagtttgtagatggcttaggctcattacgtttttcgtttttttcttcttccttcctgattttttccgtttcgtaatcgttcaagtacttatcaaaagcatcattcctttctgggaaagggcgcttaccaagtaaatcaatcatatcttctcttgtcaaaacttcttttttcagtagtacttgagcaatcttctctacatcttctgctttttctttaagcagctttgtacatctgtcatggcattcttggacgattctgtatacttcggaatcaataatgtcacctgtctcgtccgaaaatggttttgtcaaatcgctatcatctctcttctggtaattgacccagccaattttatcactcatgcctaattctgtgaccattgccgtggccatgctagtaacttttttgaagtcatcagatgcgccacttgtaactgatgggaaatgtaattcctcagaaactcttccacccagagacatggtcattctgtccttaagttgctgttcagttagtaagaagatatcacctggcaaatactgtgcataaccaagggcgccctggccacgtggaataatactgactttcagaagaggatctgcgtatttcaagtaccatccacatacagcatgtccagcctcgtggtaagccaccactttcttctcttcgggagagagcagcttggatttgcgttccactccacctatgactctttcgatagcttgttcaaaatgattcaattttactgcatcttcgtcacttctagcagcaatcaaggcggcctcgttacaaacgttggcaatatcagcaccagaaaagcctggcgtcaaagccgctaatctatttttcaaatcaaaaatttccccggcaagtttcaaatgatgtaaatgaacagcaaaaatggcttttctaccctcaagttcgggcttgtcgatattgatatgcctgtcaaatctaccaggccttaataatgctttatcgagaatatcgggtctattggtaccagctaaaacaacaacgtggtcagctggagtgaaaccatccatttctactaacatttgatttagcgtgttctctctctcatcattggcacctgaaaaattacccttttgtcttgcttttcctatagcatcaatttcgtcaataaacacaatcgagggtgcattttctcttgcagttttgaacaaatctcttactcttgctgcaccaacaccaacaaacatttctacaaattctgaaccagaaacaaaataaaacggaacaccggcttcacctgctgttgcctttgcaagcaaagttttaccggtacctggtggaccagataaaattgcacctctaggaattttagctcccattttttcataacgagaaggctctttcaagaagctcacaaactccatgatttcttccttagcctcatcgcatccggcaacgtccttgaacttgatcttaacgtctgtttcagtgttaaattttttagccttagaacgactcagaccaaatatgcctccacggctaccgcccgctgcttgtgccgatcttcttgtcaaccaaataatacctgcaatcattaaaacagttggcaaaatttggaacatagctttagcccaattgccttcttgaacatatagtacaggtattctgaaatccttatcaatgtccagttcgtcctgtgctttctgaagtttgtgttcgaagctatcaattgaaccgattgtgaaataatagaagttgcgaccgtaattgtcggcttggttttttccgttgtcatttaagatcactttcaccatggacttgttgacaacaatcaacttcgcaacgtaaccttttgctaatagtttctctctaaaatcctgccacgttatctcactttgctcttccgaactgttgaggagatccaataaaaacgaaaggaggaaaaaagttagtcctatctggaataagttaacgttcttcgatacaggattactaggatcatttagaggtggttttgggggaggaggaggtggtggcggtggaatatttctgctattgttaccttcaaagtagccctgctcttttgttctgtttgacttggcttttgaaggaccattttcctcctctttttcctttctttcttcttgaattctgttagattcttgtttcaatacagcatcttctaaacgcctaatactttcatcaattttgcgtttctgttctttccagttagccggtatagtattatttttagtttgttcgatatatttttctacttgttttcttattgcttcaacctcttcgtctgtgggaatttctttgttaagtttagcgtcttcgttattgtcctcgttcttgttaccgctcttattctcttgcagcctattgagtagccgatattgagtatgtaaactcttgatatgggtcaagccgtaataggaccggaagcgaacgggccttctaactaccttagtagcaattcttgaccaagaaagtagcaacattagtactctttctaactttaaagttgcttgccaagactcttgagtgtgctatattgtattcgttggcagctcaaaatctttcctttaaaactatagtggcaaaagttagagatcgttttcacgagaaaatgatggggaaaaatggaccaaaagacaaatgtattcacaatgtgacaccagatagcttggtgattagtatatagatcttacaggacaccgaataataccagaagggactttcttattagacgaaccgatatgtgcatgcgttatcctataaagaaatatgtccggatgggatattcaaacaagacgccggacaaaataattcacacatatggaggatgttacgtacatgagcacaagacgaaccgtacaaagagaaacatacatcatcactcagacgataagatcataaattagcagatgacactttagtttattctctttggtaggttttctacaatcaaaattatctaacggcgaacttctgtaggcagagttttcgcatcgcccaatgagataatgcactttcaaaagaccacgctgcacttgcatcaaattggtttacgaaagagcaaagtcgaggattagcacattcggcgtgcccatacgctaccatttttgacaaagttggcaacatcaagcgagacatatctacaaatatatttatccgaattgtacccgaagtgtttctggttatattcattgctaaccatttcaacgtattcagcctagtagcttgcaagaactattaatacaaaatgtcaaacagaagttctttgagttaaagtacaaagacagacaacagccctcgggtaaatctgttggtgtgtgtttcctgtatcacaaaacactagcgagcaaagaaatacgacgttatagcttttaataatacgacgagacaatgttagtggtcgtaataattttccaacaaaagtactttccaaactttgctgttatctctgtgattgtttagtacgaaaattgtatcgcgctgtcaatagcaaggggctgcaagcattacgtaagggtacactcgaagtagggatatatatttaaagtcccatcgtgacgctcataatagaacactttccctccaaataaaaattcattgaacttatatcatcggtattcatatactattgactaaacagccatgtctcctatgaaagttgcggttgtcggtgccagtggtaaagttggacgtttattgataaaccaattgaaggccaacgatagtttctcaacaccattagcgattgttagaacacaggatcaagtcaattatttcaagaatgaagtaggtgttgatgctagtttgacagatatagaaaacgcgtccgttagtgagatcacagacgctattaaggcttatgatgccgtggtctttagcgccggtgcgggtggtaaaggaatggaaagaattttcacggttgatctggatggctgtatcaaagttgttgaagcatgcgaaaaggctggtatcaaaaggttcgttgttgtttcagcgctcaaggcggaggatagagatttttggtataacattaagggcttgcgtgaatactatattgcaaagagatctgctgatcgtgaggttagaaactccaatttggattacactattttacagcctggatcgttggaactaaataaaggtaccggtcttttgcaaccgcttgacaaattagaagagaaagcttctgttaactactccattaacagggaggatgtagcttcttttattgtggaaagcttactacatccaaatgcaacagtgaaaaaaaccatttcgttggtaaatggcaacgagccaatggaaaaattcattcaaagtttgtagatcaacctatttacgcgtgaaatgcatatgtagatgaataatcaagaaaagaaaaagaaggtgagaatatatgaatttttttatcttgatttgaagataaaaatttgttatattgttacattgagtatactaaatatattcgttgcatttttcgaaattttgttgttcggtgatagcccttaaaacgtcttcatcaacaacgtcttcatagatctctttcgggatttccgacagtcccgttttcggtttattcaaatcgttatcgtgtataacggtctcatacacaatgcttgtgtcgctgggactatcgttttttgatctcctccatcctaaaacagttgttgactgtgtggattctggtatgtgtaatatatttgtgtatgcatctctcaagccttgttgatctacaagaagaaccttcactctatcataaaacaaatcgctattaaatctactacacgcagcagaatgctgatagagccaatttgtagagctcagcttactacctgatgcaataatattagaattactcatgtgaccatgtggcctgtgttcaaagaattccacctggttttttgcagggtttatgccattctcggaagcaggatacatcatggtttctaaggcccttgcagatttatcaataggatcaccagcaagttttccttcaattacatttccctttgttcttaattcagaagcataataatcatcggttatatgtttgccgccacgaatgattttagcaccaaattctttaaacacgcctctagcggtgactagagcgatttgtctatttctatatgaataaggtaaaacgccacggtctatcaagtcgttcttttgagtttgattcagaatgaacttataaaggttggggtgagtttgaaaaaataaatatgaatctctaaaacccactatcctagctggttcggtggccagcataaactttcgattccccttctcagttaatgtgaaggtgcgcactaaaaattctctgcctcctaatagatcaccatctgcagttatcttcgtctcaccttcaggatcatctggtagaacatattcttcattgaccactttcaaaggatttaagttctcctcagcatcatcgattccgggaaatactggttttttgaactttgaacggtttctagatctagtaacgcctttatcctctgacaaatcctcttcttcgtccacgtgcctccttttgtttcttccgcttttatttatctgttcctcctcatcacttatttcttcttcattcactccctcattggcttcttcttcttctctgtaatcatcatcttcattctcatcattttcatcaatatctaaatcctcagtatcaattgcataattgggtctgttgctagtagatcttgaccgcttctcatgttcaacttcggaagctagacctccctctgaatctgacatttctgctagctggtatttccttcttcaaaagtaaatgtactgtattcagtaatgcttaaactttataaagctgttttcttgcaatatttttgtctgctcacagtaacatgtttaatagttcgaacgggctttttttcaaaagagcgaagtaatcaaagcattcgggtaataattacaagtttatatggactgtggtaaaaacagtgtaaaacttttttatatctgtttttctaaggttacgtaattgtttactttatattcttatctcactcgaggacaacattccaccttttaatgcaagcgtccgcaccagaactaaccaaggtagatggtgtttcccataaaaggttgttaacaccgtccttgtgagcattcaatgccttaatgattttcataggtcttttgacggagtaaataaaaatattggtgtctaaagaaccagtggcaactaagtcctcttcaatttcctcttcgtttgctcccttttcagcaggtttccatgaaatggcgttgattttactggtgtggaaagcccatcttgaagttttcacttctcttgattgtaaatcatatagcaatatcttgcccataacatctccagcagcgatgtatgtttcagatggcgaaattgatatgtacgagggttttgcgcgaagaggtgtttttaaatcaaaactgacttccaaatctgataatttaaatacctgaatagtattaccttcttccaaaccaactgcaacgtaattttggctcaagctaacggcagagcctggtgagttcagtcttacactcttgattatatcgcccgtaaaagattgtaatatcaacaaatcatcatcatttgttagtactgcagtgaagccatcattgttcgcactagcaacctttggttgcgatccaaattcatgcttagtaataccgttcactttcaaagtatcatcccaagaaatactggagtattcttgcgctttactattatccaatgatacaatcaagttggagtgatcttggtgcatggaagagctagaccattccataatcctaccatcatatgacccactgattagtgggttgactgtcaaagcagtaatacccttgttatgaccactaatggtttttaaaacctcgtcatgtccaagttcatagaagtttaaggtcccatccagtgaaagagaaataatccttccgtttcctgttgcaacaacaccaacttgttgatttcccagttcttgcttgtctaaggtccatttttgaacgcattttgaagtcgtgatgtcccaaaccctaatggtagcgtctgctcctacggtagcaaacttttgggaatcaagccacgatagtgcaaatataccaccttgaactggttcttgatcatcctctatgtatttaagaaactcacctgatttgccatcaaagcaagaaatctttctgtcagaccctaccgtaataacaaattcaccgctgtcaggtgaaaattcaacatccctgacaaatgagccttgtttgtggtgtgttctgtcactggcagagaacttaaatggaggtccttgataaaagacaacagatccatcatctccaactgtcatagatctcataggtctagattgcttcaaatgacaagcattgatgcgttgtgagtgacctgaaacttcacctagggaattaccagaatcccaggatatgaaaacaccaaagttatcacgaccttctcccacaacgcagagtcttcgcccttcaaaatcccaggagatatcgctgattggacctgctaaaacttggaattcagacttaacattcacttcaacagaattgctttctttgtcaaatgtccatccccaaacaatcacttttccagattcgtcaccggagcataggtactgggaacccttaagtggagagaactttaccgttgtgactaccgaagagccatgaccagtaaattgtactactggaggtactttactgtctccatcgtccaaacaacgtacaaatgcagatttgccacatgggtaagcaattgcgttggttgtagggtcatacgataaatgcgtagtaaagttacgctgtgtcgaaggctgaggtggtataatttccttcaaagagatagatgacattatttttgtttactttgctacttttgccccgttaatataccttaaaaactgtatttgcgagttgcaaaaggtagaatagtgctgagttgcttccccttataattaaataatgatcattaatcaaagatctgacatatatgccttcggtagaaaaggtggcaggttacagggtgaaaacatccgtacatcatatacaattcattgtttcgaaaacaaacgaacgggacactagagaccaataaaaacgtttcagaacgtcgtggtagcgttcagttctgattatgaacggaaagcaatagctagtattgatacagctccagtttctagtcattcaccccaagtaagcataatattcaacgttctgtgacctacatacctcgtaattagtgataattatcttttgaaaatttttggaataactgaaaaattttgaaaactttcgagctttgaagaaaaaacgatgcccatcactaatagaagtcccttgaaacagtttttgctaagaacaggcctaaggataataatatagaaataaaatgtcgactgctaggcctagaataatcacttcgaaggctccattattgcctcaacagactaccccggagcagcgttactggcgtcaatacacttccgcacaactggttaaagaacataatagcgttactcacatatcattcaatcctcaacatcctcatgattttgcagtaacttcctcaaccagagttcaaatattttcttcaagaactaggcaagtgatcaagaccttttcaagatttaaagatgttgtctattctgcatcctttaggagtgatggtaaattgctttgtgccggtgatgctaccggtttagtgtctgtatacgacagttataatcccaggactatccttttatctataaacgcttccacacatcccacacatgttacgaaattccatacgcaagataacaaaattctggctacggcgagtgacgatagagtgacaagactttgggatatatccaacgcatatgagccacaattagagctcaccggagccactgactatgttcgtaccttatcatttatcccagcagccccacatttggttgcaacaggctcatacgatggtttgatcagattatatgacacaagatctagcggatccacgccaatttattctctgaatcatgaccaacctgttgaaaatgttattgcagtatctccaacccaaattgtttcttgcggtggcaataatttcaaagtgtgggacttgaccagtaacaagaaattatacgaacgtggcaatttcaataaggctgtgacatgcttggactatgttgaaaattttgattctccaatgcaatcggcgttgatcgcttcttccttagatggtcatgtcaaagtctttgatcctttagacaatttccaagtcaaatttggctggaaattttcgggtcccgtactaagttgtgctgtctcccctagtaccgcacaagggaataggcatttagtagcaggtttatcatcaggactactagccattagaactaaaaagaaagagaaacgttcttccgataaagaaaacgcacccgccagttttaataagaatgcgaaaagtaataacttccagagaatgatgcgaggctcggaataccaaggtgatcaagagcatataatccacaatgataaggtaagatctcaacgtcgtatgcgtgcattcgaaaggaacataaatcagtttaaatggagcgaagcactcgacaatgcctttgtaccaggtatggccaaagagttgacacttactgttcttcaagaactacgcaaacgtggcaaagttcgtgtagcgctatatggtagagatgaatctacattagagccgctactgaattggtgcttaaaaggtattgaagatgtgagatcagcatctattgtagcggattgggtcgccgtggttttagaattatatgggaatacgttagaaagctctccagttcttcaagaattgatgatagatttgaaaactaaagttagacatgaaattcataagtctaaagaagctcaaagaattgaaggtatgcttcaacttttaacgagttaaggaaatattagcatatagattttaatttgtatctattttatagatattcaggcatacatatatatctctttctcattgtaatcgaaaaaaataatatcttctctttttattgaaaaaaggaacctgtataaatttcattttagagtgctttgcattttgatacgttttcgcgtttaactaccttcgagggcttgaaaacaaaacattgtgagatgagatgctatcaacagaaagctgactgtgagtccccagaagtccatgtcgcttgatgccttctttcaatcctgttagattcttagagttaccaattgacattagaaaagaagtttacttccatttagatggtaatttttgcggagcacatccctacccaatagatatattatacaaatctaatgatgtggagcttccaggaaaaccaagttataaaaggtctaagagatctaagaaattattgagatacatgtatcctgtttttgccacgtatttgaacattttcgaatactctccgcaactcattgaaaaatggcttgagtatgcattttggttgcgctatgattgcctggttttggactgtttcaaagtaaaccatctttatgacggaacgcttatagatgcattagaatggacgtaccttgataatgaacttcgactggcctacttcaataaggccagtatgttagaagtttggtatacttttaaagagtacaagaagtgggtgatagacagtgttgcttttgacgagcttgacttacttaatgtaagtaatattcaattcaacattgataatctaactccacaactagtagacaaatgcttatcaattttagaacagaaagatttattcgcaacaatcggggaggtacaatttggacaagatgaagaagtaggagaagagaaagatgttgatgttagtggagctaattctgacgaaaactcctcacctagctccacaattaaaaacaagaaaaggtcagcatccaaaagatcacattcagataatggcaatgtgggagcaacgcacaaccaactaacaagtatttctgttataagaacaataagaagtatggaatccatgaagagcctgcggaagatcactgtgagaggagagaaattatatgagttgctaataaattttcatgggttcagagacaatcctggtaaaacgattagttacatagtgaaacgtaggataaatgaaatacgcctatcacgcatgaatcaaatttccagaaccggactagctgactttacaagatgggacaacttgcaaaagcttgtattaagtagagtagcttacatcgacctgaatagcattgtctttcccaaaaattttaaatctctgacaatgaaacgtgtaagtaaaatcaagtggtggaacatcgaggaaaatatactaaaggaactaaaagtcgataagagaacttttaaatcgttgtacataaaggaagatgatagtaaattcacaaaattttttaatttacgacacacaagaataaaagagcttgacaaaagtgaaattaatcaaataacataccttcgatgtcaagcaatagtttggctatcttttcggactttgaaccatatcaagctacaaaatgtatctgaagtttttaacaatatcatcgtacctagagcattgttcgatagtaaacgagtagagatttatcgatgtgaaaaaatctctcaggttttggtaatataaaaatgtggaaaaccggcggtattttaattagaaacaaactgtctgataaaccaatcatgaaatcttgtatcactgtcagcaagctctggatgaaaagaagtcacaaggatattatgattttgcgttgcagctacaaccacatcctttccattcactggcaattcatataaacttttaaccgcgataggatcaagaattctctcgatcacgggtgcgcgaataaatgtagcaggaaaattatcacagccaggtatgaaattggaaaaatcacacttttgtgtaaaagattgagcttgtcttccaaatgcgtttcttctcacgtcgaccttcaacacacctaaagtctttactagggcactttcgttttctaattgcgcgcttaaaaagatgagaccagcacaagtaccccaaactaccttttccggattatgaacaaattcgtataaacaaggatataagcctgttctttgagcgatgagggacatcgacgtagattctcctccgggaataattaaggcgtcgcactgggctagatcctcaggagtttttacagttttgatttctatctttattccgtagtcgttttcagccaaacacctttttaaatggttggtatgctccaaaaaggcaccttgcaacgccaaaaccccaattactttcatcgactttccggacattgtactgtgggttttgtgcatactttaagatatggtttttctttctatttaacgaaatgaaataataagaaaaaaaaacctggtggcatcaacgtgatttttggaagaaagaataaaacattcaaagagttcgtgaccagttattgctgataaatgccgtttactgactcagttggaatttatggcactagttggaatagctcatcatgacataatgactcagccgacaagggtaagggttgaaagccgggctttttcactacttttcaggtagcgccgccatttcttcatgactctgacacactctgccgcaccgttagttacgtctgtaattctggctgcgaagtaccattttcgatataaataggaggacgctgagagctatggacgaagtctatggtattgttggagaaacctttaggaacgactagcaaatatacacagtactaatattcagttaattatcacgatgactggagaagactttaagatcaagagtggtctcgcccaaatgttaaaaggtggcgttattatggatgttgttactccagagcaggcaaaaatagctgaaaaatctggtgcatgtgcggtaatggcattagaatccatcccagcagatatgcgtaagtcaggaaaggtttgccgcatgtcagatccgaagatgattaaggacatcatgaactccgtttccattcccgtcatggctaaggtaaggattggccattttgttgaagctcaaattattgaggcattggaagttgactatattgacgaaagtgaagtcttgactcctgctgattggactcaccacattgaaaaggacaaattcaaagttccatttgtttgtggcgctaaagacttaggtgaagctttgagaagaattaatgaaggcgccgctatgattcgtaccaagggtgaagctggaacgggcgatgtctctgaagccgtcaagcatataaggagaattacagaggagataaaggcgtgccaacaattgaagagcgaagatgacattgcaaaagttgctgaggaaatgagggtaccagtttctttgctgaaagatgttttagaaaaaggtaagttgccagtagtaaattttgctgcaggtggtgtagcaacgccagccgatgccgcattgttaatgcagttgggttgtgatggtgtgtttgttggctcaggaatttttaaatcatctaatcctgtaaggttggccactgcagtagtagaggctaccactcactttgacaatcccagcaaattgttggaagtatctagtgacttaggagagttaatgggtggtgtatcaatcgaatctattagtcatgcttccaatggagtaagactttccgaaattgggtggtgatttctttgaacaggtattttgagcattataacactttttcccccctcaactttgtattactcggtacacattgtaaaatgatctaattattagataagcttatgtatgctggatattatttactagaatacttgattggggttcccttttagtttgttagacaatccctcatacgaaagatctcctaacttttccaattgatcatttacatagtttttataagaaaactcgtcattattcaacagtacctcagggtcaaatatgataccctttccatgcaacctccatttgttagtccactcgatagccgttgatttttcattttggcttttattcacttgaagccttcttaaaacatcatatatatcatttgtgggagaattggtgcttccagggtaaagctctgttcttccatcgttcaaattttgcaagttcattaggtataaaaggtaatccgcttgaaatattggatctacaaggttatttttaacactaccacacaacgccagtcctagcattctattatgatctgaaacgcgaccgggaacaccgattcctggagtatctatcaagtatatttcatttcttgattccgtattccgtgaagttactctaataacctcgcttgtggctctagtaacaccagcttctgcaccagttttggctactttcttaaattttcttcccatattcacttgattgtgaaaaattgtcctcaagctatttattaaagtagattttccaacatttggcatgccagtaatcaatgctcggtatcccataggtagatatccgccatttgtttctagttcgtaattttgccattctagtatttttagtagattcctgacgtcagttttgtttcggcaatccagtaaaataaacttttctcccagctcttcatgccaattctttaactttcctatatatggcttattgccgggcataagatcctttctagtgtataccactaatttcatcacatcgtgttcctttcttgctattcgatcgaaaaccacattccttgtagataacggggcacgtatatcacgtagttctattatcatattcatttgaggaagcaacttttcaaatgttttaagagctttgacttggtgtcccttgaaatcagtgagaggcatactgtactttggaaattcatatcttggtgtgaaggatgaaacgttggaaattattttcctagttcctctcacatttatgtgcatttctgtatttgatttggcttttttgcattcaggtctgagtaatgagcattatcattcgttctttcttctcctaataactaaaccaaattgtttcgaaaagacaaaaattgtgtacttttgacatgatggtccgtgttctttgatctgcggcaaaatgaacctaccatgtggcagaattaaatatttgattcaaatataaataaggcgaacgacgagagattaagatattatatacaggtaatactattgattgtttgttccacggactaggaattcttccaatgtggaattctccattccagcggtttttaataacgctttaatggagttgcataactccggagttacgttaacatttaaacgtctgatccatagcaaatgaccattatttacgattttcgatataacgtgactatcaccgctttgattgataacatttataaattcattccagggccttttgtcctgaccttccccttccgttggtgtgatagcttcccagacttgaagtagcttattccagtctttgattttggccaagttttgcaatattgagacaatcatgcctgaagtcaacttatctccaaatgtttggaaaatgtggtctattgtctcgtagagtgatctcaattttacccgttcatccgcgaccatggaatttaaaagaagggatattaccacttcatcgtaaacaactgagccatcgtcctctgtttgtagacctttaaataggttcaaagctctgataatcaccctattttgctttactaggttaaagtatgaatgactagaatgctgcgttttcaaaaccatttctaaaagagcgattagatcttcccttattaactcttgccccaacgatttttttaaaagtagataatccttgaggaaaacacgatctgaataaaattgtgggtctgctttgtttagaagtatcgcatattctagtcgtagtggccaatatgcagccgattgatttatggttaaaaaagttgaatgttcgtcaaataaggacttccattgaacaacatctactttcctctcttgtcctaccaaatcctttaaagtatttttaacatgctccaaagtacgtatattgtgagtttcagtaccactactactctgaattatcttattggctcctttgaagtcttccttttgtagaaagtatcttaaattacttagcccgtttgggttgatagttgaataccttctcctttgctgggccagtcttcttaggcctaaaagaatattattgttgcttgaaatttcatttacccctgaaatagtagggacattacctgaatctatattttggaacttagatttctcattttcaggtgcatacagctcttctaaattcaattcattacgccttctctgtgtcaaaatatttacaaaaataccatcgacacgacaatcaatcatataccaagcctcactatttaagtcttttgcagagcattcagagcttctacctaatagtttactaaggttggattttcttgctaatcttctttttcttctactttcttgtcgctcattaaagtttccttcaacgtatgcactactacagaattcgtgcttcaaaaacttgttcaactctaagaaacttttatgacaatgtttggtagatcttgctgtacatatgaccatgaagtcacccaacttattaacggctgaaacagagtttgggcttttcttccgtaaatcgaaaaccaggaagtcatccagaccaagtttaccagttaggaggtctgctatttttcttaatgagtttggagaggttttaggtatctccaattctttgttcatcgtgtggtggttatttttcttaccttccattagttccttttcattgtcaacaatcctgaggtaccaaggtgtttccagaggggtaaaagtagactttttggatacacgactttgttcatgactgtcatttttgccctttgtcgagtaataaactgctgtgatgtgactatgaagaaaataagggccctttttgaataatatggtaaaaggaatattggccacgcctatcctcttgccatggaaaggtagtagacagaatttattcatgtcaacaaacctcaatttttgaataagcaggctattacacttaatcttcacttggtgtcgatctttcttagtagcttaacttgcttttttttttttggctgaatggtcctcattgtttctctttatcgggatgaaaagcataattatcagaagattgcaagtatattagaagagaggttagaaaaagatgtcaagaaatactagtaaaaacaaataccattactgtgtactagagtactatttaagaaagacggattatttctaaagttacgatagttcggatgattgtgaccccatttctaataaaaccaatattatcaggtatatagaaatgctgcaggatcttttcaagcatatatgataccaccaaaaaagtgtaaaatcccatataatataacgttcttctatttgtttcgtacagttcgctgattggtattattacatcaggaatattgtatgttcgcttcgttaaagtttgatcgctgtttcctatatgcggcgtctaatatatagatgatgagaatttgacaaataatgagaattgttaggatccaattatacttaacagctataataatagtacacaaaatatactaaaagttctcctcgaggatataggaaccctcaaatggaatccatatttctacataatagtattacgattattcttcactctgttttacatgtttcattatcctattacattatcaatccttgcatttcagcatcctctaacttcgatgacagcttctcataccttatgccatcatctaacaccgtatatcataatatactggtagtgtgactactagttgatagacgatagttgatttttgatttttattccaacagtcctgatgataagttactgtcaaagacataattattatcaaaatatatggtattagatggactggtaaaagtacaaaacttcagaaatttgtccgtgatagtttaatggtcagaatgggcgcttgtcgcgtgccagatcggggttcaattccccgtcgcggagatttttttatcagaccaggtgggtgttgtttgatcatcacaaagtagaattcagtgtcatttttaaaaacgttacttaattttacgataatatgctgccagaacaagtttaacaatacgcttttggcaatttgttcttgctgcacttggaattaaataagagtcttagtaaacagaatgttgctttagttgttcgtcaacaaaaacaaagataaaggatggaggtaatcaaatagcccacattaagaaaagtatacaactgggaatttactttataaaaattaccgttgctacatttttttatattatttattgaatagcttgatatttcaattcttctttgcaaagtaattgataagcattccattttttaccaggagccaaggaaataaaatcatgaacatgaccaggttcaatacatatcatttgttggtaaccagtttttggttcgaaatcggccatcccttgagacttctcaatccatggattccaaacaacagtgtcgggcaagttgtatctttttagagtgtgaatttgaacgcccttgtcaactatttgaatggcccgttcggcgctgacattctgataaattacatcggtttcttgattgaaggtaacgactgggtgcttgtcgacgtaggattccttcaacagttggtcataaagtttcatgccagctaaattagagaccattgttccttcaatatcttcgatacggaagtatgtatggaacaaccagttgaactttaattccttggaactagatgtgttttctacttctatggcagttttcaaataatcggagcctaattcaacagtcaaaatcaaaagataatccattggccacaatttggtcaattctgggttagcaatttctggtttcaagccaaattgtacggtcggtgggttttccttagtttgacccaaaaactcccaagtagaatttcttgcaagaccatgttgaggtaatttactcaaatgttcatcggtgctatttttcccgaatacaggaaagaccaaaggtataccacctctcacaggtttgctaccatccaatttagcagcagtagacaaccacaactgttcttcagatttcaatttccaagaataaactgtagcaccgtactttagaatatgaacgctggtggtctcatcagctggatgagtcaaaacaacttctttatcagtttctttgataggcatggctttgtgttttaatctttcttggttcaagttttaccaaaggcttataatgaacctcagaatcacctctttattcatttctagggacctactaagttttctttcggcgtgaaaaataaaaggcgcattggtgaccccatttgcgatacctttttatggaaagacagcttgaagaaagaccttgttatcattgactgcgtctagcgaacgaggacatctacacactatttcttctgctgcaatgattgatgccgtttagatgaatggtcgggacgtaacttatgttttaagaagaaggcacttttcctggtgcaatagatgaatctcggtttcaagttaactatataaatatggggttggcattatatgtcatgctttattataattaggcatataaaactacatggttatgaaaggcgctggcagtaaaagggttgtttgtcaatggcaagaattaatcattctcgcattgaaatatatgtagatcgaggtgaactgttagatggtccatcagacatttattattttgacttatgtatttccctctcaattttgttatcagtaatcgagtcatgtgtactttaaagttcatattctcacgtttttcgcaagatattagccgccaatagcaactccgaataataagagctatataaaggccgttgaagcccacggaaagagaaagaaaactaatagttattacaatatagaccgttggttttttctttccctcctggagcagctgcgtatagttactacctaagaagtgggctagaagttggctagaagtgggctacttaatatatatctttggatacatagaaaggaaccaggaaaaaggaaaattatttagatggcttccataagtttatgatggttcaaacggcaaaaagccttttgactatttttcttggttgaactatcttcttattaggcctactacaacaatgcatcgagctaggataacaactagaatactttggttatgtattgtatgggtgttcagtggcaaaatttgagagttgggttattgatggtcggtctatacaaacgaaagacctagagcagctctcaaggaagaaagtgctggacaaacttccctatctgaagagaaaaatatccgttttttatatagtttctgtaagtgtgcacagtgacttcctcattagagcgatatagataatttgagactttatttattttttatttttgttggttctcatattcaaccttccatttatctaagttgaaccattaaacattccctttttttactttgctaatttcatcatacccattgatcaactataagtgaaacttgggaatcttccattatacaaaggtgaggtccctatttgttgcatttttcaattcatttccctgggagtttttgtttgtttttgctatattaacatatcataacagcgtatagaacgtaatttgaaatattcaaaacaaagaaaaggtaaagaaatgagagactctaatcatcgatcattaacgtcgaacaagcctatagtaacaataacatctactgtctatgaccgaagagcattggatatcaactctagtattccgttaataaactcactaaactacttaacatatctaacctctaattcatcaaaagttagggaaacggtagctaacgacggtgctctcgaaagattagtctcaatattgaggagttgtcatttaagtttgtttgagttgctggatttggatttagaaaattttaatgagcacgaaaacataaaggatctatggaaggagaaaagactagcactatgcgcttggaaatggactttaacatttcagtgcttagttttgacaggtactagagggacagaacaaattcgtaaaaaagtggtaatgtctggggtcttatctgtgctggtcacagtattggataactatttactatatcataaaaattacgacttcatcaaagatcaaacaatgacctttgacttcaaagggataaccacggagacaatgtataaattcatgagaaaagatgagaatgaaacatatcagcagtatatagagttcattacaggtcaggataaattgaagttgtcaactgacaaaaattttctaaacgaacgattagtggcaccgtctatgacaattccaactgattttagtgatatatggggccggtttgcagacctagctagcaattttgaacctgaccaggaaagacacgacgacgacattgatattgatagtgaagtagaaagtgaaaattttgatgcacataagaatttcttttcgcaaccagacattaatagacctacaatttccactccacgtgaattttttctcggaagaattgtccccaaacaagacgacgttatatggtcgcttcagttattagcttttgtttcgaagtatacatatatgaaatcaacccttcaaaatgttgagctggttgaatccctatcgttcagaagtatggcttacaaaattaaacagagaatctcagaagagaatgacttagaagaacaagaaagagacgtaactgtaaaattgtcttcattatatccttatttatcgaaaaatcctgaaaacaattccaaagttaaggcactagatactagcaaaatggatccatttttcaaagaattagaagaactctcaaacagatgtcaacaagaagaacagaatgaaatatgtaataaccactgtcccgttcttaatttgtttgagcgctaccgtgtaccgaaacctagcgacgacaatgcctatggcaaagacaaggaaagaattaatttaaggaagaaaatatctgataactttgaaaggcgctggagctacgataaaatgaaaaaggaattaacaaatattgtttacaaaaacaaggtactaacaaatgttgtaaacatcttccccttagtcgaaaaatatacagtgagcgcagaaaatacacacgatattatatattggagttctgtcatcatgagaaattcatgtcgaaaaaatgagattttaggtgtgcgtcagtgtgccaatttttcgtgcggaaaatgggaagattttccaagacaatttgcaaaatgtcgtcgatgcaaaagaacgaaatattgctcacgaaagtgtcaattaaaagcatggggatatcataggtattggtgtcacgaagttggatcaagtcatatgagatctacgaatactaccacaggtgtcaataccccaaatgagcctagttctttaaatgccactgctactacagcagctgatgtttcgaattctaccagtacgttcactcctaatatatccaccaccgtacctgatgaaataagcaatagggatgaaaatagcatacccgagtaaagtacaaggggatttcgatgacctaggtttaacaagatcatgaaatattcattaacggagttttttgttttcgcttttttattttttgttcctaatttttttttttttttacattttattagctatacacttggcgcaaggatattttatataccggatataataaataattaaaagactactaattaaaaatgatgtaatatggtaataggtatggaagaatcagggagttttcagaatgttctttgccctctcttgggctttctagttttgcacttttacttattcatctcctgtaaccgaaactgaaatgggggggtttggaaagttgtacaataacatagctgttttcttttttttaaatattgaaggaacgctttcatgtattttttcaaacaatgagtgattcttctcattatatttttgaatggtggaaaagaaggaccatttgagaatcatcaagtacatagcaaagaagctaaaatttggccacaacgtatcactaaattcaatggtggcattttcatgtacttgccatagcatatagtctgagagcctcctatgcccacttgttctgattaataattcacatttattggaatggaaacccatgtacattttattagtaaattttcttatattaatccttggtgatttattttccaaatggtcttcaactgaatcacgaatagtatgtaacatatcatttcttgaagtgtaaggaaaacatataaataaagtgaaatcgtctccatcctgtgtgatttcttccacctttttaattttttttctcatttctggagatagtaaagattgatcacctactattcttattttagatccgtataagggatccttatagtccttggctctttttgcgaattcatcaagctttaccgtaaacaaattcattagcgtatctactacttcttttggtctattaaaattttcaatagaaaatgcataggcggaaacacattttacacccaatcttttgcagatatacagtagtgttagtaacgttaacccaccagcttcatggcctttttttactggtagccttcttgacttggcatatctccggttaccatccatgataaaggagacatgttcgggcacaggccctacccttaacgcttttatcaaaatattctgaagatttacataaaaccatgaaaacaagcttaatgacataacccacgcaaatactctctgaaatatacttttcactgcgaagcacatctgttctttggtttctaccaaaagcctttttagggctacaaactgaatctgaatgatactgggtattttcattatggtcaacagaaacgtcctatgttggaaaggcagtctgttctttataagttgataaattgagaaaagtgcaccaaatcttaatctactctgtgtgtatttttaggtcccttaaataacagaaaaagtatagctttagccgccgaggtccactcagtttggagtagttacccttaacaggcactcactccgttttgttctttcgaagagatacgttatagtatatcggcaacaaatgataggctcattgttagcgttcattaattattagattaaaatttatttaagtgtatcgtgtttctttactttatgtacgaagattaatatgcatttaaaggtatcacccacggaaaaaaaaaatccatcagcgttagcggaagttattaactactgtaccgcagtctacgcaataatagtttctatcttgttggtcattagcaccagaaaaagcctcaaaccttgaaccgttacaaacattgcaacggataggtaaattcattgcgctcgttggagtggtaggcccatgtgcattggagaaaatagatgacatgctttcccttggtgttcttggctgtgcattactgccgagtgtttttagtgatgtactgcttttgggacatatattagagtatccacgtcccgttgcatagccttttccagtattagtatacgccgctgccggttggccagccaagtttgatttcgctctcgagttgaagcttcgactcaaagaatgcaaagaatcagaactgttaaaccttctccgaacctctctattgtattcttctagtttgagtaacacgcgctttcttataacagagggcatatctgctctaaacacacgaatagtccctacgttatcagtactgatcaatatcgttccaattgcgtcaacgacatctgggatagcactggtggcggaagcattagaaattgagcctggtttagaattgtagcccaaagacgactctacatctgacattatgccatcgtcgttactccgactcaaaacatcgaaactatcggatgtctgaaaaaactctagagatagctcgcagataacatcgttagacaaagataatgttttcgaagtttctggcggtgcaatgctaacacaagtaacaggggcattgtgtgcatgaaaagaaatgtaatccgtatttttgatgtaatgatcgttgctatgatgaggcaagggaagtaagttagtaagttttaagtgatgatgtggtttttcttcgttattctggctggaagacctactcattgatttactaaatatgcttctcaaacttccggaccgagccaatccctttggtttccttttaggttcatcttgatcattctctctatccgaagactttaacctccagccgtaaacccaatggtcatcactactatttacaacgattggctgaccatgccagatggacaattgcgccttgtgttgggaagatccgctatggaagcctttcaatacctctagaagcttcctctgttctaagtcaaaaattcttatcctcgaatcattcgatgtaactactaagcggaaagaattgtccagttgagatctaaaagcttgcaaacccgtcacacgtggaccatgacgaatttttgagtcagtttccgtgaccatgacgtgagcgttttgttcttgtgtttgtctatcagctacgtgaaatgaagaaactggagtgagacctctggtcatcagaatatgaacgtatccattaaatgttcctattatagtgtattttccctcctcaggggataatgtaacagatgttattaagtcttgacaatcgtactcaaagctaacttcatcatccagtatagaccataacctgcatttgtgatccagacagccgctaatgaaaaatctatcgtcggtggggtgaaattccacacaagtgacaaaatcaggatgtatgaatgtcttaagtgaatttttcctatcgggatgccatagttttactgtcttatccatcgatgctgacaaaataaaatcatttttagaccaatttatatccagaacatcttgcacgtgttctttatacagtcgcaaaggcgttgggtgaaagacaggcgcatacaaattcaataatttttccttctcttcgtatttctctgtagcagaatccaaaaattgtttttcttttggattgttcaatgaactgacctgctgtttgatccgcatcgacttggctcgtgcctctttatttgattccgcactcgagtccaattcggctctttcaactggagagccaataactttccatattcttattttaccatctttgctaccagtggccataaattttccatcgcggctaaactttgtactccatatagctttagaggttggttcagatgatttggaagtggagataaccgtttcaccttcgtaggccattagttcttgcgcgagaaacaatcttctaaattgtttcaggtttttccgacgtttcaacattttaatgtattttggctctctcaaatagttttcaaattgctctgtatcaatggaattgaaagggtaaaactcattgaccctaagattcgaatttaaagtattgcctctctgtaaatgttcctttagtctcataaatgaatcagtggcgttgccgttgttactatattttaatttgtcatttgtattattagtttttgtcattctgaacttcaatggctcgatatctgcagaatattcaagatttagtttgcttttacttttactttcaccggaactggactcgccgtcgaagctctcttgatgcgaccgactctcctcttcagatccagtggtattcgaggaattgctgaattcagaatgtaccttgcttatacttgttttatcctccgccatattcgtcatatttctaattctcgtactatattatacgccactaccgtatacaatatgccaagagctcagcaactgctttctattctttttctttgattgtctttgttcctcttttccctctttcttttcctcctctgtttgacaagttggagagagttgcagtcttgttccctatacggtccagctgtgacttgtacgaacgcgtattgtatcccaggaagaaataatgatgtaactcgcttacgaagcttaagaaagggcaaaaaaaaatgtgtcccccctaactgcgaaagtgaaaaaaaaaaaattaatgcgttgaatttacacagttctatgtataattaactgctacgatagaaactggacagtagtaagaaagattggactaggcatcacccagactttactttttcggcatatatatctatttatatatagtttaatacgtaaatacaaatatatatatactgtaaattttaatcattaagcttttcttttttttttgttcacgctttcaccctgtgaggcgaatgaggttagctttttccctttacgggactaggtaaggctccccatggctgagcccgcgcaaggaaatccaggatcatccgcggaagaaataagctgctcccggcccagactatgtaagaaaagtggcaacagacagaaaagcgaatctttcctttcaggcaatgcaagggtcctttgccgtttggcgaattccggtaacctcgacttgcgccccgcgggcttcgctttgacatccgcgggtataagcgtccgtccttcggccgacaacaggtcggtctttgatctcaattccgtagacggaagaattctgataatgctgtaaaagaaatgaataagtaacataagtcgtgtgagagttgctaaaagaagagcgcagcctctacggaccattctattttctgtagttcttcttgtccccgttaaacacaatagtaacggagtgcgtgtcgcaatctacttgaactatccatttttgaaaattgcaacctcttgcggctatagctataaattccgtccggctcggctcggcttggttcggcttgcttctaactaatgcttctcccctgcgaaggagagtcacccaactgttcgtcaccaatgtacgtccacccaccaaactgcttttgaatacttgcacttaagtactcgtccactacactatcgatcggtttttccttagtgaactcttggtcaaaatttgcagtatctatttcactcttaacaagtggcttgtaaggcggaatatagcccttcaaaagtagctttttccatgagatgtctttaaagaaaggatggttacgaatttcatctgtaccgttaacgccgagtcttctgcttgggtctctgcttaagaggccaattaataggtctttagccgcagggtcaaatccatcaggaaatagtagcggttgctgcagaattttcttgtacataacaggaacgttctcatcatagtatggtggcagccctgtcatcatctcatacagtaagatacctaatgtccaccagtcaactgttttagtatagccctgccccaacaagatttctggtgccaaatattcgggagtaccacagaaagtgtctgttttgtcattatccttcatgttcagcttgcaaagcccaaaatcacacagtgcaatatgtccttggtaatccaatagaatgttttcaggctttaggtcacgataaatgacgtcaagtttgtgtaatgaatcgagagcacataatagttctgcaatataaaaacgggagcgtgctagactgaatcgtccctcgtgttgtaaatggtagaacagttcaccgccattaatgaaagctaatactaggtacaacttctccggagattggaatgaaaacttcaacggaacaataaaggggcagtcaactcttgctaggacagttctctccgctaaagtatgtgtcacttcacatttcgatacaatatatgcttttctcagagccttcaaagcgtaaatcttttgggtatcttttttccttacttgcatcactttgccgaacgaacccctcccgataaccttcaatagatcaaagtcatcaatggagagaggcttgttcttagaaggtttgtagtccaccgtgatatttaatttaccatatcccctttctaaagaaatccaatggtgattgtatagtcttatttgggctgcagaatcgatttttaaattcaaaggtaaatggaaggagtccaaatggatatcctgatttgtattgattttttttaaaatctccctcagtacttcgtcctgctcgccaatctcctgttgccagtttttagagggtaaaagtaaggatggaatccttgcaaagacatcgatttttaaaaatcttaattttcttgttacatcaaatgtcgatattttgttaaacactggttgctccatcgttcccatatctggactaatagtagtaatagaattatcaaattcaattgtaaaataaagtaatgggcttgaatttgttgacccaggtaacaatatagaggaaggaatgaatttagtagcaaaagctctatctatcaagccttcccctgctgaatcttgatctactctcttgtatcgtggtagctgccgcattatggctgcaacttcggaagcgtcattggatgatgaagtaaggatgccggaacttagtagtttttgtaaaatagtagagttagaggtgatagggaagggaagagtaaaatctttaccagaatacaccttcactgtcattagtccggattccgaactcggtccctgcgtctcagtagacgactgactagctttcctttcggaagccttagaattgtcatttcctatccccgatggattcttgaaggatgcatcattacgtaattttggagaacttaaggaacttgggagagtctcatttgtattgatctttcttatatggtgttcgtgttcatgattatgattcttcgggctaccatcgtgatgtttttctccatggtggaaatgaaacaggccattaccccacgatttttcattttcatcttcactactcccatcatcttctttggaccttcctaacttaaacttggatattcgccaggaatgcatgttactatatgtatatttgtatacgcgataatttgacccagttgaacaattctggtttaggagcactttggctgaattttatcattttatttataaatctaaggatgacggccattttacagatttctcgagggaaatataataaaaaactcggggtaggtaatctgaattcggggatacgctaatttgggaaaaatttgtgaattagatataattagaaacagcacttatgaagaagatactgcgattaaccaaaatattctcctccttatgaaaaaaaaaaaaaaaaaagactcagaaacctatgcaatcgtttgctaatatgtcgaaatatggatctattaagtatataaagtatgtgttcaaaaaattgaaattttcttctttaccgttaatattcattaaaaaaggtgaaaatcattaagccattagtaaatcattcgttttaagtacgaaccgttggttcttcagttcctaaaacttgtttaaagttcaagaacttgatgaccgagttaataattggcttcaagtattcttcagctgtcttttggtattgtgatttatcatcgcagtatttttcaatgtacaatctaatggtagcacctgaagaacctgtacctgacaatcttagaacgaatcttgcaccattggaaagcttgacatataaaccttgatggtcagaaacagaaccgtccaaatctgtgtatgaaaaatcaccacaatcggtgaccttaagagactcatcggctgggaaggcggaattaacaacacccgatttggtaacatatgctctcaattgatcgacaatcttgttagctttttctgtttcaactttttcaaaatcataacgagtgaagaaagtacggccgtactttgcccagaattcattctgtatcgtcttaatagaagcttcgttctccggatgatgcttgttgtaaatggccaagatgttcaaccacgccataatggcccaaacaccgtccttttcccttacgtggttggaaccagtaccaaacgattcttcaccacagatagataattttttagcgtcgaacaaagcacagaaaaatttccagccagttgggacctcataacagtttagaccatgggccttggcaacacggtctatggctcctgaggtagggaatgaacgggccagaccatatataccttgcttggcgaaatatggaatttcagctgcatattcggcaataattgcgacggagtcacctggagaaacgaaagatgggccgtaaccgtaaatcatatttctatcaccatcaccatcggatgcagcaccaaactcaatcttttcacgatctactcttttcactaacgaactggcataagttaagtttggatctggatgcataccaccaaaatccggagaaggatgccagttttgtaaaacctcatccgccggtaaaccaaattcatcaacgaaaatagccttaccgtatggtccagttacaccgttcatactgtcaaacagtaacttccaattcttagtagaacgttgattatcgatgaatttcttgattaagtcgaaatcgaagatttccttcaagaagttgacataatcttttgtaatatcgataatgtcaacgagtaatggaccgtatttcttgttcttgcctatcgtacccaagtctagttctgggaagtctttgataatcttatagctggtaagctttttggaaatctcccaaatagcatttgtgacggattcaggagcaggacccccattggataagttatacttaatacccatgtcattttctggaccacctggattatgtgaggcggttaagataataccaccagtacatttttcctcgtaggttctcatgatgtgagaagcggctggcgtagacagaagaccatgctgaccaataactaactttttaataccgttggcagcaccgatagcggcaatcttatgaagaatgacatcattgtagtaacgcccatcaccaccgacaacaagagtggcacctttagaaccctctggaatagcttccatgatcgattgaatgaaattttctgtgtagttaggttcgtctttaaacacctttgtcttcttacgcaaaccagaggtaccaggcttttggtcttcatatggtttggtgggaaccgtttcaatttgaaatgacatgttatgttaacttttgttactttttttactgagaaagattggttgatcttcttcttattatcctattgttcaagcaacgctgaagaaagacatggaacactatcttcgaaaatgaaacaatattaacggtacctttttatatttcccacattgttcgggcggcagtcatccagattctgaaagaatcaactatttcttttacacttttcaacccctgtttgttcctggaactgcacataacaaaagtataacgtcccctttcacgtaagttccccacgaaaaaagtagtgcgcgacaccaccccttttcgtgagctccgcgcttctcttcaccgagcctaagttgggcctctcccccctagaaagaacaagttggccctgttgtccttagctcgcaagctcaggggcagcagcgtgtgttgagattagagaaccgctcgacctcaacggatgatagtatgattttagtacatacagggaacgtcctctacccacgttttattgttgttgcatttacttttgaacagcgacaggggggaaggtgtaaaggaggaaaagcaacctgcatggctagtgttcaaagttacaaggtaacaatgcaaatcagtagtatgacaattatttacccgctatttatttttttttctctttaactgtggtgacgaaaacataactcaaaggatgttagacctttttttaattattgctattgtttggacttcccctactgtgttgttcaccgcgcttcaatagcgtttctaggtccgggatcttttccctctcaagctcagtttttagttcggagtcgagttttaatttgtctactttcttgatgccgagcacttcaaccaattttgtgctatcaaatttcttgtgcgtgtaaggacttattttgtttttcaatgagtcaggaagctctgggatttcaaattccctggaatcattgatcatcagttggtgaatccattccagtagcacctgttgttgcctgtagacaaaaaccgtgggtattctaagaggatcctttttgttttcctcttggtctttatttaaagagggaagtgggagagtggtgtctgttgttacttcgcctatgggttgatagtagttgcctaacggaatctctggtagctcatctgtatccattgaatctacaaattgttccataagctcatcgatttgatgcccgtctgtttcctttttcagcggtaccccggatgtagttgttcgatccagaagttttggaaaatcagttaccctctcgtcttccgcgaatggtaatctacacaaggtaaggctcttaacaaacttcttctcggaattaatgttactgtgctcaattagaacgggacacaatgcacacatattcacttcactgtctttcttgctcacatatcttgcaacagcaatttttctattttctagcataacatccactagagcactgaaagccattaagtcagattgacagccaagtcttgtgtcggcggtaatgaaggaggattccgacgtcaaaaagtaccttggaagagcttctctattcaaaaatcctcttaaatccaagcctggaaaagattcatatacagtttgatcgactagaacggacggtagcactacgtagtctgcaccataacggtatgccttcgttacagagtctttggagatggtcacgggaatgtatgacgatccagactggtcatcttcactgacatttttcttatttccttcgttgtgaatttcatattcgattatggatttgacccccacatacctttctttcttctgggagtcttccacctcaacagcggttttcctatttaagcctgaaactgctttcgtagcaggaaaagcctctaccttgatacataagcaattttcatcttgcatgctgccgctaggattcgatatttgtgttgataatatatctgcccctaacctaagctcgcctgagaatactcttactggcttaacgacagatgttgctggggaagtgatttcaacaagaagttcattcatattgtagattcttgaattcggtatcgcttcgaccaactttaaccagttcgattttttcctctcctcttgagtgtctttaccgcaatcaatcaaaatgattcttgtgcttaattcttccgttagcaggtctatttcttcatcagtaatatccagatcatctaaattgtctgtaaatacaacaatttgttttagaatttttcttgcttgaaattgttgtttaatatctaatgagacgaccaacagacattgaatcattgattgtaaaccttcattcgaactatcatgactgtgctgatcacaatattgtttcaggcgttttataaacccaatggtggccgtcgtggtaacaggagccaaaaaggattgtatttggaacacatttggtatttcctgggaattctcagatacgggacaattagcgagataacagcttatccaatctgtttttctactttttttagatttgtttaatagagtgtactctagatatgccatagatttggaaacattattatttttcatcattgatggtgaaacatccacgatgaaagttgttgactcacttgacattattatggtgtgagatatattatttgtgcatatgtcctgcactctcgttaattaggttttcttctcttgatgatgccctttttttttattcatttttttgcatgacaacaaatgccctgacggacatgcggtaatctagttgaaaaaatagtcaaattgtgtcgacactgtaaaaaggtacttccgctaatagactacaaacattactccaagaccagaaacagaaatacgttacaatagtgttgtcgaatcctggcaatggtaaattgtttttaacgccctccaactgctaatctttggttgacggtacattcatctattataagaactaaatatatagattaactagaaaaggccagatgtcttaagtgtatatattttgaatgagaattatgtatgcagcatatttacttgaatcttcaaaaaaagaagccctgtagggggctcgaacccctaaccttatgattaagagtcatacgcgctaccgattgcgccaacaaggctacttattgttatttacagtcagcttgtattcttatatgtttagctggtttttttatctcagcttttactttctcaaagttaataaaactattcttctagaaatttttttctggatttcggttgctgaactagttcaacaaaaatatttattttaaaattaaactagttcaaggtctcatagtcgatgattttgagaaatgggtgaatgttgagataattgttgggattccattgttgataaaggctataatattaggtatacagaatatactagaagttctcctcgagggtctaggaatccccataatggaatctatatttctatataccaatattacgattattcctcattccgttttatatgtttcattatcctattacattatcaatccttgctcttcagcttcctctaacttcgatgacagcttctcataacttatgtcatcatcttaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagttgatagacgatagtggatttttattccaacagatttccaatcaatcaaagcaacccacaaatcctaggctgaatcatgatatcgatggaagcaatcaacaattttatcaagaccgcaccaaagcacgactatctgacaggcggagttcatcattctggtaatgtagacgtgttacaattaagcggcaataaagaagatggtacttttagtatggagccatacttttgttgatgtagacaacaatgtgatagctaaatttgaagacgctctcgaaaaacttgaaagtttgcaccggcgctcatcctcatccacaggcaatgaagaacacgctaacgtttaaccgagaggagacacttcataatgatgtgagaaataagtgaatattgtaataattgttgggactccaatgtcaacaaaagctataatgtaggtattcagaatatactagaggttctcctcgaggatcttggaatccacaaaagggagtcgataaatctatataataaaaattactttatcttctttcgttttatacgttgtcgtttattatcctattacgttatcattcttcgcatttcagctttcattagatttgatgactgtttctcaaactttatgtcattttcttacacctcatatgattatatactagaaacatgaatactactaaatagatgataaattgaatttcattgcaatggtgatgatcattgtgattttatttgttggaataacaatcaactatcatccattcactggtattaatattactggtatattatctaatatggtgtaggtatatggcataatattgagaaacggctatcggatgtggtaaaagctaaaatgcgaagattgataatgtaacaggatagtgaacgacaacgtataaaatggaaaaagaggtaatatcgttattatgtaaaattatttgtgtcctttgtggactctaagatccttggaaatttaaatgaccggagaatgagatcgctataatagtttctatactcatcgaaaatgcaaccgataaaaccattataaatcttcgcggttatctggcattgttattaaccaaaaaaatgccggcctattacaagctactgttcaataaatattgttgtaatgaagacggtccaactgtacaaaatacagcaaactgtcatatataaggtgtcttatgtgacagcacttgcgttattgtcagccggagtatgtctttgtcgcattctgggctttttactttctgctcagaaggaagtacgaacaagaaaaaaaatcaccaatgcttcccttttcagtattagtttcatatttgtttacgttcaaactcgtcgtttgcgcgataacctctaaaaaagtcagttacgtaactatatcaatcagagaatgcaaaaagcactatcataaaaatgtctctaggggatgtgagacatgtcaattataagaagtgatggtgtcatagtatatatatcataaatgattatcaaagtttcaatcctttgtattttctagtttagcgccaacttttgacaaaacctaaactttagataatcatcattcttacaatttttatctggatggcaataatctcctatataaagcccagataaactgtaaaaagaatccatcactatttgaaaaaaagtcatctggcacgtttaattatcagagcagaaatgatgaagggtgttagcgccgtccattgatgcgcctggtagtcatgatttacgtataactaacacatcatgaggacggcggcgtcaccccaacgcaaaagagtgacttccctgcgctttgccaaaaccccatacatcgccatctggctcctggcagggcggttgatggacatcagccgcctcccttaattgctaaagcctccacaaggcacaattaagcaatatttcgggaaagtacaccagtcagtttgcgcttttatgactgggttctaaggaactagatgtgaagtagtggtgacagaatcagggagataagagggagcagggtggggtaatgatgtgcgataacaatcttgcttggctaatcacccccatatcttgtagtgagtatataaataggagcctcccttcctattgcaactccataaaatttttttttgtagccacttctgtaacaagataaataaaaccaactaatcgagatatcaaatatgggtagtttttgggaagcattcgcagtatacgacaagaaaaagcacgcagatccaagtgtatatggaggaaaccataacaacacaggagacagtaaaacgcaggttatgttttcgaaagagtaccgtcaacctaggacacatcagcaagagaacttgcagagcatgagaagatcttccataggatcacaggacagttccgatgttgaggacgttaaggaagggagattacccgcagaagtagaaataccaaagaatgttgacatctctaacatgtcgcaaggtgagtttttaagactttacgaaagtttgaggaggggggaacccgacaataaagtaaatagataaatggaggagatattcatagtgtcttttcttgtgttgtctatttattctaacatgattatatatttattatgcttttcagtgtttccattagttttatatgatagcatccttatgtcttttttcatacctatataagcaataagaagttatgtaaacagaactttgccactaataccataattactgtcttttagtatcattgtctgtcagtcggcacggatgaaaggtgacaaacgcctagccgccggagcctgccggtaccggcttggcttcagttgctgatctcggcgcggaaaaatcagcgccccacgccaaaaggttcgtattttttctttttttttctaatcttccatctattcggtagcgatgattcatttctactaagaaaaaaaaaaaaaaatagaaaaagaatatttttttgatgaacttgtatttctcttatctggttgatatatatgctatcatttattttcttatcaagtttccaaatttctaatcctttctccaccatccctaattaataattcagatctacgtcacaccgtaatttgtattgtttttttccttcattgtctaaaaccgaagaattcatcagccacagttactagttcatttgaagtgaaattacacacattttccctgttacaatagaaagtattttacaaaatctaaaccctttgagctaagaggagataaatacaacagaatcaattttcaaatgatcagacaatctacgctaaaaaacttcgctattaagcgttgctttcaacatatagcataccgcaacacacctgccatgagatcagtagctctcgcgcagcgcttttatagttcgtcttcccgttattacagtgcgtctccattaccagcctctaaaaggccagagcctgctccaagtttcaatgttgatccattagaacagccggctgaaccttcaaaattggctaagaaactacgcgctgagcctgacatggatacctctttcgtcggtttaactggtggtcaaatatttaacgaaatgatgtccagacaaaacgttgatacggtatttggttatccaggtggtgctatcctacctgtttacgatgccattcataacagtgataaattcaacttcgttcttccaaaacacgaacaaggtgccggtcacatggcagaaggctacgccagagcttctggtaaaccaggtgttgtcttggttacttctgggccaggtgccaccaatgtcgttactccaatggcagatgcctttgcagacgggattccaatggttgtctttacagggcaagtcccaactagtgctatcggtactgatgctttccaagaggctgacgtcgttggtatttctagatcttgtacgaaatggaatgtcatggtcaagtccgtggaagaattgccattgcgtattaacgaggcttttgaaattgccacgagcggtagaccgggaccagtcttggtcgatttaccaaaggatgtcacagcagctatcttaagaaatccaattccaacaaaaacaactcttccatcaaacgcactaaaccaattaaccagtcgcgcacaagatgaatttgtcatgcaaagtatcaataaagcagcagatttgatcaacttggcaaagaaacctgtcttatacgtcggtgctggtattttaaaccatgcagatggtccaagattactaaaagaattaagtgaccgtgctcaaatacctgtcaccactactttacaaggtttaggttcattcgaccaagaagatccaaaatcattagatatgcttggtatgcacggttgtgctactgccaacctggcagtgcaaaatgccgacttgataattgcagttggtgctagattcgacgaccgtgtcactggtaatatttctaaattcgctccagaagctcgtcgtgcagctgccgagggtagaggtggtattattcatttcgaggttagtccaaaaaacataaacaaggttgttcaaactcaaatagcagtggaaggtgatgctacgaccaatctgggcaaaatgatgtcaaagattttcccagttaaggagaggtctgaatggtttgcccaaataaataaatggaagaaggaatacccatacgcttatatggaggagactccaggatctaaaattaaaccacagacggttataaagaaactatccaaggttgccaacgacacgggaagacatgtcattgttacaacgggtgtggggcaacatcaaatgtgggctgcccaacactggacatggagaaatcctcatactttcatcacatcaggtggtttaggtacgatgggttacggtctccctgccgccatcggtgctcaagttgcaaagccagaatctttagttattgacattgatggtgacgcatcctttaacatgactctaacggaattgagttctgccgttcaagctggtactccagtgaagattttgattttgaacaatgaagaacaaggtatggtcactcaatggcaatccctgttctacgaacatcgttattcccacacacatcaattgaaccctgatttcataaaactagcggaggctatgggtttaaaaggtttaagagtcaagaagcaagaggaattggacgctaagttgaaagaattcgtttctaccaagggcccagttttgcttgaagtggaagttgataaaaaagttcctgttttgccaatggtggcaggtggtagcggtctagacgagttcataaattttgacccagaagttgaaagacaacagactgaattacgtcataagcgtacaggcggtaagcactgaatttcaaaaacatttatttcaaaagcattttcagtaaaaaatgcagactttattattatttaatcgtgcttcttatatatgacattctaccaaatcggtagtcatgtatatttttttcgtatatactttatatatttttttctaaaaaactaatgacggctaaaattaagtcatagatgaataataagttcgattcaagtgagttggtagtatttgataaatctaaagtggatacgtagcacatgtattcaaatggtgtgttttaactcgtcggacacgacttctttctcgttttgtcaatcatcaaaaatatttcctgaaaaggggccgtcaaaaattgcaagcttggaaaatacaaactggactatgtatttaaaggttatagtttataataaagcataagaacagtggccaatacgaatttaaccgctttatagaaatggctatcttaaaaagaggagctagaaaaaaggtacatcaggagccagctaaacgctctgcgaatatcaagaaagctacttttgattcctcgaagaagaaagaagttggtgtgtctgatctgacgcttctttctaaaatctccgacgaagccataaatgaaaacttgaagaagagatttttgaatgctacaatctacacttatataggtcatgtgttaattagtgtcaatccattccgagacctcggaatctatactgatgctgttatgaatgaatacaaaggtaagaatagattggaagttccaccccatgtatttgcaattgcagagtctatgtactacaacatgaaatcatataatgaaaatcagtgtgttattatttcaggtgaatcaggtgccggtaaaactgaagcagctaaaagaattatgcaatatattgcggctgcttctagcacacatacggagtcaattggaaagattaaagacatggttttagccactaatccattgttggaatcttttggctgtgcaaagactctaagaaataacaactcttctagacatgggaaatatctagaaataaaattcaataaccagtttgaaccatgtgctggtaatatcacaaactatttattggagaagcagagagttgtgagtcaaattaagaatgaaagaaatttccatatattctatcagttcacgaaaggtgcttccgatgcttataggcaaacatttggggtccaaaaaccggaacaatatgtgtacacagctgctgcgggttgcatatctgctgagacaattgatgatttgcaagattatcaagagacattaaaagctatgagagttattggtctcggtcaagaagaacaagaccaaattttcaggatgttagctgcaattctttggattggtaatgtttcctttatagaaaatgaggaggggaatgcgcaagttagggacacctcagtaaccgattttgttgcttatttgttacaaatagatagccaattgctgattaagtcacttgtggaaagaattatggaaactaatcatggtatgaaaagagggtcagtgtatcatgttccattgaatattgtccaagcagatgcggttagagatgctttggcaaaggctatttacaataacttatttgactggattgtgagtagggttaacaaatctctgcaggcttttccaggcgctgaaaagtccattggtattcttgatatttacggctttgaaatctttgaacataactcttttgagcagatttgtatcaattatgttaatgaaaagttacaacaaatctttattcaattgacattgaaatctgagcaagaaacttacgagagagaaaaaatccaatggaccccaattaaatactttgataacaaggttgtgtgtgatttgattgaggcaagaagaccacctggtatatttgcagcaatgaatgattctgttgcaactgcacacgcggattcaaatgctgctgatcaggcttttgctcagcgtttgaacttgttcacaacaaatccacattttgacttgagatctaacaagtttgttattaagcattatgccggtgatgtcacatacgatattgacggtattacagataaaaataaggatcaattacaaaaggatctggtagaattaattggtaccactaccaatacatttttagccaccattttcccggatactgtagacagagaatcaaaaagaaggccacctacagcaggcgacaaaattataaagagtgcaaatgatttggttgaaactttatcaaaagcacaaccttcatatatcagaacaattaaaccaaacgaaaccaaatctcctaacgattatgacgatcggcaagttctacaccagattaagtatctaggtctgcaagaaaacgtgcgtatcagaagagcaggttttgcatatagacaagtgtttgagaagttcgtggaaagattttatttattatctccacactgttcttacgctggtgactatacatggcaaggtgataccttagatgctgttaagtatatattgcaagattcctctatcccacagcaggagtaccaattgggtgtcacaagtgttttcatcaaaacacctgaaacattatttgctttggagcatatgagagatagatactggcacaatatggctgccagaatccaacgtgcttggaggagatttttgcaaagaagaattgatgcggccactaagatccagcgcaccatcagggagaggaaggaaggtaataagtatgagaagctccgggattatggtacgaaggttttgggtggaagaaaagaaagaaggtctatgtccttattaggttacagagccttcatgggtgattatctatcatgcaacgagtccaaatcgaagggcgcttatatcaaaagacaagtgagcattaaagagaaggtcatcttttccatacatggtgaggccttgcatacaaaatttggccgttctgcacaaagattgaaaaaaactttcctattaactccaactacattgtacattgttggtcagactttggtccaaaatgctatgacctatactcaggattataaaatcgatgtgcgaaacattcaagcggttagtttaaccaatttacaggatgattgggtcgccattaagttggctagctcaggtcaacctgaccccttaatcaacacatatttcaaaacagaactcataacgcatctgaaaaggcttaacgacaaaattcaaattaaaataggctcggcgatagagtaccaaaagaaacctggaaagttgcattcagtgaaatgtcaaatcaatgaatctgcaccaaaatatggcgacatatataaatccagtacaatatcagttcgtcgtggtaacccacctaattctcaagtgcacaaaaaaccgagaaaaaagagttcaatctcttcaggatatcatgctagttcctcgcaagcaacgaggaggccagtttcgattgctgcagcccagcatgttcccaccgccccggcttctaggcattctaaaaagcctgcccctccaccaccaggaatgcagaacaaagctgctacaagaagatctgttcctaatcctgcttccactctcactgcatcccaaagtaatgcccgtccttctccccctactgctgccactcgtgctacacccgctgctacacccgctgctgccgcaatgggctctggtagacaggcaaatatccctccaccacctcctccacccccaccctcttcaaagccaaaagaacccatgtttgaagcggcttacgattttcctggttcaggatcaccatctgagttacctttaaagaaaggagacgtaatttacattacaagagaagaaccaagcggttggtctctcgggaaacttctggatggctctaaggaaggttgggtgccaacagcttacatgaaaccacattccggaaataataatatccctactcctcctcaaaacagggatgttcctaaacccgttctgaattctgtacaacatgataacacctctgcaaacgttattccagctgcagcccaagcaagtttgggtgatggtttggcgaatgcgcttgctgctagggccaataaaatgagattagagagtgatgacgaggaggctaacgaagatgaagaggaagatgattggtaatcaaaatgtatttagcgagtatatactctatacgagcaaatagagtaaattgtaattaataaatattgatatattatcgcccatatgaaatttttaaacgaaaggttacttatacatcaaataattaattaaccttaaacattacgttcaggaagaacaatgagcgtaaatggtactaattaaaataacggcggcagataatgaaaaatattggcgtaacccccacttgttattgccatttctgtcaaaccaaggttttctttccatcgcaaaacggacgagcttttccttttgtgcgctatttggagggtatctcataaaaagggtaaaatcattccaatatggttgtttgaaaattgttctttcatgactaaaggtattgaatccataatatccaccatagttaccataacctgaagtaccgatccctccaaatggagcgtcggtaattcctacatgaatcactgtatcaccgacaacacagtcaccagatcttaagcgcgtcaagatacgatttatttcagtttggctatcagagaatatgtattgcaccaatggagtgtcatgttcttctattatcttgttaatggtctcatcaagatcctcgtactcaatgatgggcaatacaggagcaaagttttcctgtttcatcaaaggatcatcccaaccaatgttataaactatggttggtggtacaaggcatagatcctcagtatctgaattaatagaaatttttgaaggcacaatcttggagccgttagttgagtttatacttgcaacggcctttttgtaagcaggctcatgaatcatacgagtgaaatctgtttgttcatcaaagcttggataaaattcatttagtaccgattcacactctttaatgacctttggatagatagatttatgtactaacaaataatctggtgaaacacaaatctggccagaatttccgaaagctccaaaaaaaatccttttcaaagcaatttttatgttacttgctttgaaattttctgtaataaaggtaggtgatttaccaccaagttcaagtacacaaggtgttagactttttgctgctttctcagcaactattgatccgacacggggagaacctgtgtagaatattaggtcaaattttccacaatctagtagtcttgtagtttcatctatagctccctgaactacttgaatcaatccatcagggaaaccagctgtggttaacaaattttccataactacagcagtgtgtggtgttagttcacttggcttcagaacaatggtgttacctgcagcaagagctgctgccaatggggcaaatgctaaaagtaggggaaaattgaaaggagcaataatcaagacactgccccttgatattttctccacgattgttttaccaaacataaatggaggagaagaatcagatactctccgaggtttgatcaattttggtaaaatctcaattaggtgaagtatatcgttcataagtttggtcgtttcattcagaaccgattcaattttgttccgatgaaagtccttgtacatagcatcgatcagttcttcctcatgatctttgacggcataatagagttttttcaactgcaactgcctgaattctagatcttttttccttgggttattttcgtgggacaatttcaattgtttctcaaagaagaaatttcttgagatttcaactatttcatctattttagacactggggtataattcaatatttttgagccgtcgtttgacatgttggtgataaattactatggctatggttttagaatattccttttagataatcaatatgcctgaagttttgttttttatatatggagtatccgtttatccctaaaatccgaagaatctcctcctaaaacgacaaaaaaaagggtaagcaatccaccatctaattaaatcactaatattagattgaattttcgaacctatctaaaagtgggatcttgatgtaaaattgactgatagataaaaggcttggagtcgatagttgatatatcagtacaccggtaattgtctattatataccctgttggcatgaaatccatataggacggtatatatttatatataaaatgcatgtaaaaatctttcatcatgaactactcggaatttttggctggaaattcgttgttccatttcctctaagtgtcttgatcatgttctggtgtgcctgtactggaatttggtatactatgtggctgctgtaatgataatctagcttctctctcttctaacaagaaaattcttcttggcttccctcttctctttagagtaagtgaatagtcttcgagtttgtccatttttttggagaagtattcgtataactgggacattgataatcggcaatgatgtcctttgaaggtattgtttcccaatcttatattttcgacaaccttgatggcttggtttctacttattttattctcaggtagcgacaaaccatatttgcttggatcatcttttatatctattattctttttatgatggtcattcttttagtgaacaaagtcctttctttggcagatcgcctccaagtggacccatatctcctctcaagggaaagaactgacggttggcccggtaagccttcaaagtattcacgggccgcatctgtaacgttctggattgcacgatttagtttatatgacgttccaacgcaccctcttctgtttctgatatcattctcgtttcctgttccatcgagttggttattactgtcatcagcattgctaacagaatcggggttatttaaaggtaggttcctggtggtagcgttctcatcactttcattaccatcgtattccccattttcaaagtctgacagccctggctcaggcttgatacgaggatcgccggctaatatgcttgcgtgcatactatattcttgccagtttgttgatcttgactgactttgatgagcttgcgtacttgttgatggatttccaacacgagcagcttcctgaggagtaacattttccccagtatggtctataaatcttattctctccccagtcataataccaactacctctttgaagacttctttcattgcggaaacatcttcaacatacttattgatgtctttaaatcctttctccaacttcttttgattctctagaaagaagagttcttgttcctttttcattaggctgatttcttccttcagattggcattttgctcctccattctggttagttgtgctataagaaatgcattgaaatttgtttcaggggtttcttttatccttccagggcctattctgttggtcggttctgttgccgatgctgatgtggatgtagacactatgggaggttgagcagcgtctgtcggtctgaaaagaggattgatacggcctgggatcatgtacctatttaatgcagcatgtcttgatactcctgttggacttgtggttatagttcgctgccctagatcgtgattcctgcgttcagaatctctatctgaatcatcatcgtccaacgagccgtacccaccaaaaccttctacatagttatattctcgagcgggcatgtttaattaatgtgttgactcctggactaacttctcggtggcacaaaatgtagtcttctggcaaaagacgaagttgattgttaaatattttaagctagcaatgccctttgtactctcgtttgtgtttgagtttcaagtacgcttcctttttttaatttttttactaatactaaactcgttctctttagacaatactggttgaagtaaagtaaatgctatatcatcatatggaatatgatatccctgtgatgtttatataattatacatttgtacttgatacaaaagtgttctagtcctaattaaggtttacttggatttcgaaggatctaatatagccgacaataaatccaattgttcttccattttttctgtgtcttggcctagggccttcttgttgacattgatgggcagtagtcgtgttccaacgttctcatccaacaactgtatctccttgcgtagctgtgtggttgatttatctagtcgttcgtaaaactgtttgacatgattttcgaattggggtttcactgattcattacctctttttagttcaccaaatatgaacgtgacttgagacgcctcctgcaacatggagcataactgggtctctatatcatttaatgacttaagacgttcttgtatatatggtggctgcattgtttcgttttcttgtttcgtttcactcttcgtattgagaacctgcatcgttgttcatttggatttgatagcgtccttctaataagcgcgcctctggcttgatgagaagatttgaatcgaattagcagatctaacgactgggtcaaaaaaccgctaagatgagggcctgcatactgtccaagtcagattttcgtactcattcgattactttcaaaatataaaagccgccgcaatgagcgacttaaatcaagtttttaaaatgtccaatatacatatatataaataaagtcaagatttttttatcactggatgtttcaaagcttctcatacggtggctacgtcctggttaccatatttcttgtgttatatatattatttataggcccttctacaacattggttagttcgggtgttttcctctatgaataattgttatttaaaaattgagcagaaaaactcaggattgtttataatgtaaatgttttgaatagaccgataaggtcacctgttagtaagttgatctagtgtatttattgtattttgctatatcaatggccattgaattgggactttcccgtattacaaaactactagagcatttaggcaatccgcaaaactcacttagagtgctgcacattgcagggacaaatggtaaaggttcagtatgtacttacctatcttctgtgttgcaacaaaagtcctaccaaattggaaaatttaccactccacacttggtgcatgttactgattccattacaatcaacaataagccgattccgttagagagataccagaatattagattacaactagaagctttaaacaagtcacactctttaaaatgtacggaattcgagctattaacatgtaccgcattcaaatatttttatgatgtgcagtgccaatggtgtgtcatagaagtaggccttggcggaagacttgatgcgaccaatgttattccaggcgcaaataaggcatgttgtggtattactaaaatcagtttggatcatgaaagctttttaggtaacaccttgtctgaaatctctaaagagaaagcaggtataataacagaaggggtacccttcacagtgattgatggaaccaatgaggcaagtgttataaatgttgtgaaagaaagatgcaaggctttagggtctgaactatccgttacagattctcaacttaacggaaatatgattgacaccaactcctggggttgttttgacttggcaaaattgccactgaatggagaatatcagatatttaatctcagggtggccatgggtatgttagactacttacaaatgaacgaacttattgatattaccaagaatgaagtaagtacgagattggcgaaggttgattggccaggaaggttatatcgtatggattatcgctttgacaaagtaagtaataggacagtgcctatattaatggacggtgcccacaatggctcagctgcagtagagttagttaagtacctaagaaaggagtacggaaaccagcctttgacctttgtgatggcagtaacgcatgggaaaaacttggagccgctgctccagccattattgaggcctatagatcaagtaattcttactcggtttaataatgtggaaggtatgccctggattcatgccactgatcctgaagaaataaaagattttattttgactcaaggatacacaaaggagatagtgattgaaaatgatttacatcaggtattgccttctctggcgcatgtatcagacgagcaaagacggccaattgttgtatgcggttcactgtatttatgtggtgaattattacggattcacaatagtcacttgagaaactaaataaaataagtaacaacgaacattatatagactatcgatgataaacaaactaaaaaaatgtcatttttttatttttttcttgcctctggagtctttctggtttcccaacatatttactatatttctcttctctctgtttccctctcttttgggtgacaaattagcttcttctctcttcactcggtcacctatacttccttcctctggtaaagttgtttcctcttgttcttcattcttttttaatccatcataggaattccttttgaggcttttcttttgattaaaaacatcttcgcctttcaacgatttgtcaccctttacacctcgattatcaataccttgttcgttatcattttctagcaaggcttcttctttttctctctttacgctgaacatgtccgaatcctctttcaaaagcggttttatcagccgctctccggtgttggtagtcttccccacatcatcggtaacttgatagaattgtaactttgattcatcgtagtccggcttcagcagctttaccagttcttcagtgctccatgtcgttttatccacatccatccatgcatcccaactttcggtgcctggttccagcacgcaaggcattctttcgtggagccattctaactctctggggccttgtgcagttattatggtgaacgtatataaatcatccttttcgacgtaatcatacattcctgctacaaacatcaatctgccgtctcgtctagaaatgaaataaggcgtcttctttttccctacggttttccattcaaaatatccgctcataagcacagcacaccttttcttctcacagggtctcatccacattttgctctcttgtaaattctctaaacgggcattaaaggtacgataggtcttgaattgtgaaacgtccttggtccagaatggtacaaggccccatctcataaattgtattgctttagtatcaggacgatataccgcagagtagtttgtaggggaaatattgtaagaggccttgaagatatccttactaacggtaggctgatctttggtgtcttcctcgtcatgtggatgctggctgttcgatgaggcgtccttgggtgtattaaccggtaagttccaatctcttagaagttgcggcaaatctccgctatcgtaagctaaggcaaacctaccacacatcttgggttatgaaagtctggtattagcatcaggtatactttaattaagtctcttggttcaactgttcattgctttgttcccttttttgatccctttcattcagatatttttcgtgggggttcggcctcacaaaattgcatttacaaatcatcaacatttttatgcaaaagtgggctactttcatttactcacaaaggtgtaaacacaagcaggaagatctcagtttaacaggctaaaagtccctccttttcggtatgcttttacaaggaatgcgtttatcgcaaaggttacataagagacatctatttgcttccaagattttaacgtggactacgaaccctgctcatatacgccacctacatgatataaggccgcctgcatcaaacttcaatacgcaagaatcggcccccataccggagtctccagcaaactcaccaactcgaccacagatggcacctaaacccaatttgaaaaaaaaaatcgtagtttaatgtattctattattggggtttccatagtaggtttatatttttggtttaaaagtaactccaggaaacaaaaactacctctttcggcgcaaaaagtctggaaggaagccatatggcaagaaagtgataaaatggattttaattacaaagaagcgttaaggcggtatattgaggcgttggatgaatgcgatcgctctcatgtcgatttattgtcagatgattataccagaatagagctgaaaattgctgaaatgtatgaaaagctcaatatgcttgaagaagcccaaaatttgtaccaagaattattaagtcggtttttcgaagcgctgaatgttcctggcaaagttgatgagagtgaaagaggcgaggttttaagaaaagacttgagaatcttgattaaatcgttagaaatcaataaggacatagaaagtggcaagagaaaattgctacaacatttacttttagctcaagaggaaattttaagcaaatcgccagagttgaaggaattttttgaaaacagaaaaaagaagctctcgatggtaaaagacatcaatagagaccctaatgatgattttaaaacatttgttagtgaggaaaatattaagtttgatgagcaaggctatatgattttggatctggaaaagaatagcagcgcttgggaaccctttaaggaagaattttttactgcgagagatttatatacagcttattgtctgtcatcaaaagacatagctgcagctctaagttgcaagataactagtgtggaatggatggttatggcagacatgccaccaggacagatattgctatcacaggcaaatttggggtcattgttctatcttcaagcagaaaagctagaagctgacttaaatcaattagagcaaaagaaaagtaaagagtccaaccaagagttagatatgggaacatacataaaagccgttagattcgtacgcaaaaatcgtgacttatgtctggaaagagcacaaaaatgttacgacagcgttattgcgtttgccaaaagaaacagaaaaattaggtttcatgtgaaggatcaactggatccttcaattgcacagtcaattgctctatctacctatggaatgggggttttaagccttcatgaaggtgttttggctaaagctgaaaaactattcaaagattcgatcactatggccaaggagactgaatttaatgaactccttgcagaagctgaaaaggaactagaaaagacgacagtcttgaaagcggccaaaaaagagggtttaaactaataccacaataaaggaaataaaggaagacaaaaataataaatatttcaactgtacatatgtattttcgcagcaaacagaaagcatagtttatagtacctaatgataacctttctttcattacttcgaaatctatgacgattatattatacactaaaatatagaaattattttctttatttttaccattttaaacatgaccaataactagaagatacataaaagaacaaatgaactttatacatattcttagttagcagtcataacttgccaaactctaatgacgttgtcggtgtaaccggcaaacaaagtttgaccgtcagcagaccaagccaaagaaacagcatgtggttcagcggccttgctgtaaccagcaaattctggtctcaagtcatcgaccaagtattgtgggtccaaagaaaagaccttaataccggtagcagtggcagcagccaaccagtatctgtttggagagaaagccaaagagaaaacttcatcttgggcagacaaagtgtacatagccttcttagcagccaagttccacaacataatttcaccgtccttaccagcggaagcaatcaaagttccgtctggggaagcagtcaaagtgttgatgttggagttgtgaccgatgaagtcagcttcaatttggaattggtttaagttccaagcctgtcattatatcatttttgttagtaagggaacaaaattaatttaaaaaaaaagtttccattttgacataacgagtaaagagaagagcagagtaatgctaaaccattcatcagagatcttggtgataattggtatgtctcattcggaactcaaagttccatctgaagtagcaaatatgttattacatcatttgaatggcatacacaaatccacttttcttcttctactcgattgtcatcatattctatcatggaaagaaaatatatcacataccttaaccattttgtcgttaccggcagaaatgatggtgacagagtcatcatcagctttttcgtttggaacaactctgacttgggaaacccagtcattgtgacccaacaaagtggccaaacattgacctttgatggtccagaccttgatggtcttgtcacgggaaccagagataatcatggaagccttcttgtcaatgtcaacggacataacatcggacttgtgaccgacgaatctttggtaggtttcaccggtggcaacatcccataatctcaaggtcttgtcccaagaagcagacaaagcgtaagcaccgtcagcagtcaaagtacagtcttggacaatgtgactgtgacccttgaaagatctaactgggacaccaaacttttggtcgtcaccagtcaacttccaggagatcaaagtcttatcacgggaagcggacaacaataggtttggttgaccagcagaagtagccaaagatgtgacccaaccgttgtgaccttccaaggtacctctcaaaactaaaacttcgttagatgccatttttcactttatttactttagtgtgttataaggattttttggaaaaaaaaagagagagagaacgagttaggaaaaccaaaggagcagtcttaaatataagaaaattttcaagttgtagaaaatccacaattaaaggaatagcccaatgccaaaaaaattggtcttacacatccaaaaaaaagttgcgtggatgaaatttttttcaacaaacgttctgagactttcgctggagaagcacgtcctcgctaagaaattttcagaacggagcgataacgaagacggcctaacatccgtacatagtcataaggctacagatggccaggtttgggggaatataagtatggtgatgagtattaccagtaacacaaacaaatattttgacaaaccagttacgttgtgacagtccagtatcttttaaacgtagaatggtgcatctagagtaaatattgtagttatatcacaccgagcaaaatacgtggttccaattcataatgctaataattatgctcagctcattgaatatgtatgccactgtagtattttattaatgatctcaattttcactttcctaatctttcccagatgtatttggtcttatagaaatcgctgaggttattgtccaagggtaaaatatcaatattcccatcattttttctgttaataaggacttgatcattttctaaatccaaaataactcctaaagatctgtatagcttcaattttagaatattttcgtttgcttccggggtgaccgcactttgttcttccagctcaggttcaattacttttgcttttattttggaaccgttcggtgtggatattatttcactatctttgaggtacaatttcatcttttcgtccaattcacttcgaagtgacacaatattacgttccaatccgtccaaatctttcagaagtttaactagttcgtctttactaccaaactcattgctctcttcgttagtatattctaagtctccctccaatttagcaacatttattctttccgcattcaatttcttgttcgactcagaaacctttgaatgctctttactaattcttgcttcgctttcctcttttataacatcaagatcgtgtcggattcttttcatggcatcaacatcttgctgaatatcaaaactttctctgacctcttttaaaaattcaaccggattgtcgagtaggttatccttttgtgacatggctcttgcgttccttccctttacacttgctcttccctcgttacttctttcatctatagcaaagtccctacgtaagttattttgaagacttcattgtttacatttacttttgacgcgcctgtcaaggtcgggtaacctcttctgctttcgcgggtccttctacgttgaatcaaatttattgaatataacattataaagagtatcataaaagctatgtagcaaaaaacactaagtacattccttacatttcatttactgagccagtaaatacgttcctaagacgagtgtgccggctaaaacgattgatccggtttttataaccccacggttggtcaattcgtagcccatatcccagatgagatgccttataccgttaccaaaatggaatgcaaacagatatgctgcagagcctttggccacccattgggaccacttaggcatcttttcgtgataccacttgtttagatcctgaaaagtcgtatccattcccattattgtcgtcacacccaaagtaattgtgaaagcatagaatccaagagccagtaaaacgccagatatacgatgtaaagaggaaagataccagctcatttcaggttcgtaaacagttaaatgaggagagatcggtctttttttcctttgagatactaagagctcctcttccttgttgcttgaccaaagatcagatttggatacgcggccattgtggaattctttggaaaaaaggtccattctgccattagagatataattatgcaaaataaatggtgtgctgattcttggcacgaatacagatgctcggggaactccaaatacagatgttactctttgaatggttgctttcattattcttacgcttctgaatatttctgagctccacttatcagctatcacagtcgcattgagtgtgattaatttttcggtatattgatactatttcatttttatttgccattatctaaaatcttcgtcaatttttttatgagcaacgtatccctaatcccttttttacaaaagtccaaaatagaaaaaaaactattacggatgcagtgatctctaattagggatacttttccttgtaatttggtttatcgtacggtaagaatgaccgaatgagtgatggttttgatccgaaccgtaaagaaatactggtagaagtgtttactctggttcctttcaacgacatggtatacaactatattgcatgagaactggatgcgatgcaagtacttctggtacaaacatgtaaatactattgattatattacagtaattttgtcaaaacacagtggcacaaagtcatttgataatgtgataggataacgaaacatataaagcggaaggacaaaaaaaaagtagtgatattatgtagaaataccgattccattatgaggactcttatatcttcgagaggaacttctattatattctgtatacacaacattatagcctttgatcaacaatggagttcacaattatcaaaatattcgcacaatattcacgtagaatagtggatgacagagtatataaacaaagaaagaagcactcaggattttctataaatagtgaagttttctatggacgccaaaaaatcttaagggtatcttgagtgtaatcatcattggaaggattattatctttcacgagtaaaatactattaataactagtaatttccgtgaagtcattaaaatgaacaaaacgataaaacggtttcttattgctaatgtgctgattttttgccaaaaggtaaaatctaaaaatatcaattgcataccttcacatttggtatattaccatataatagcaagatgacataaatcggtgaggagcagttaccaaattccatggaagatgaaaaacagggttgataatataataaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaacaatggaagaaaaataataatattaccaagcaaaattattgtccttgtggatttcgatattttcaacaggtaccttagtagagctgaagttttttcaaattaaacatttatgtggtagtcatatatatgtgtcatgcgagtctttacattaaatatatggtaaccaccagagaacttgttatattagtcacgattaataatgttggaataaaaatccactaccgtctatcaactagtagttatattatcaatatattatcatagacggtgttagatgatgatataaattatgagaagctgtcatcaaagttagaagaagctgaaatgcaaagattgataatatgataggataatgaaacatataaaatagaaagagggataatcgtaatattagtatgtaaaaatatactgttnnnnnnnnnnnnnnnnnnnnncaacattcacatatttctcatatacattccattttgaggattcctatgtcctcgtggagaacttttagtatattctgtttacctaatattataatcttttatcaacaatggaatcccaacaattatctcaaaattcacctatatctcaaataataaaccgatcggactgcgttcagtgaacctctcttatatagtataggaagatccaaatttattattcgctgatatgaccttttgacctttacatattaacgaggtgcttttaccaatgcatagacgagcagcttatcccataatgagtttaaattctattcaactcataacaacttatagttgctatagtcacaccttttcaacagataagtggttgtttggccgagcggtctaaggcgcctgattcaagaaatatcttgaccgcagttaactgtgggaatactcaggtatcgtaagatgcaagagttcgaatctcttagcaagcattatttttttctcgcgtattcctttgagggcgcccctttatgttgaaatattgagaagctacgaatcaaactttgaagtcagttgagtaagcaatatgaaaaacattggaaaatacaataaaacacaattacgaaaactatattgttttgaacagaaaaatagaaggaagtactaaaattactctttcaccacacaacaattttaactcaagaagataatcactgcttacttttatattttatagacaatttgcactttggggtatttttcttaattttatctgggtttttttcttctttttacaaagaaactatgctaagaatatgaactcttccacttcttcagaaaatgtgttcataaattcatttagctatttgaatcaaacatcacaagccgtaatctcaggtaactccactttcgcaaatgttatcaactttccttatagacttggattatcctttattggggctgtgaacttgcagtacgagcaaaccgttaaatctgaagaaattcccccaactctaaggtctgtttttgatacaatagggttttttttcagcccgtacgccatattttgctttgtaatcgccattgtcctgaaccggttcgttgtattttacgccgtccttaacaacggttccagacgtactttaccgttatggttgagtaatgttttccatgtatcagcagtagttgtattagcaatggtatccttaggtccgctgaccttgggtaaggatttcaaaatattaggcgaccctgcttttgcccaagaaaaatttttactgaatatattctacgctttcgcttactcttattgtgtcgaaaccatatttaccatcatgcggaattccagccctttggagggcactgactattcattgtttgaactttcgattcagttttatacaatgactaataataatactaaatttttagattctcctgattacattatagactgttctatggctattttgagcaggatattgatccatttggtggagattttcaggcttagaaattatcgtctactttttagtactattatgaacctctgtcatatttgttacttagggataagagttaagcagggcggctggaaaagccttccattttcggtgaaatttaggcactttccaaaactgttttcagtgtctattatttgcttatcattactgatttttaaattatcatgcttaattagatgggatccatttggaaaatcacgtaattcttgcgaacttttacagttttaccctctcagtagaaattggaaaaaatacttaaattacacgggagaagaagatttttctgctatggccactaaattcgcactattattatgctcaggaactgaactaatggaaaagggtatacgaagagaatttcctgctattaacatcccggataatgttaatgagaaattttttattagcggttatttaaatgaactttctaaaccgtataaagagaacacttccatcagcttcccaaagaaaaattcatcaatattaaagcaaagattttttttaatgtttccaaaatctataatatggatcatgaagaagcttgtaggccaagtattctttggcttcagagataacaaggacgaggacatccccgacaacgacccatcaaaaatgttaaagataactaaaacgaactctctcaataatagtgccggccacaaagaagatattgaacttgaactattgaacacatcagatgatgagtattctgaagattacgagccttctgaagttgagtcactgggggattctgatgaagaaaacttggaagaagattcactgattttcaacgaaactcgggatgccctactggatttattttcttccgaagataatgaagttcatactgattataattggatcatgtcaactagccgtatccttcaacaaaaattactgtcagataaaactttgacaagggcgtctatcttagatacaaagttaagtgaagtagatgagacttttggtacagaaagtgattttgatctatcttgcgcggtatgcaaagtcaatgaaagaaatacagtattatggccctgccgatgttttgccatttgcgaggattgcagaatttctttgggtttacgtgggttcagcacttgcgtatgttgtaggagtaaagttcatgggtactgtaaggttcatcctgtttcagatagtaaataatagtttaagaacttttgcatggtatctaaaagaggtttttcgtttgggagctctagcattaattactatagctagagctttctgtgttgcacatataaacatcataataataaatcaagttttttttctttgggaaatgttcgaattaaaattgtacttataacatatcgtatcattagtatatatataaaagtgtcagtggcgattatatcattagaggaggaaagaataaactatacatcgatttgccgtcatttctgtatttatggcatattgactctgaactcatgccatctaatggtggaacaaacggattgggttctctacgtaaaccaaatcgaatgaatcggcagctgaaaatacaaccttgtccatgacagaaccagatggagcggcaatgtatttgacaccggatttaactgctctgtaaacattgtctgggaatgggaaaaatgcatccgatgacaaagaaacgttggttaatttactcaaccattcctttctttcttctggagtaaatggttttggaatctcctcgaacttcgattggtattcagacaattctggttcttctgttggaatttggccggttacgaataaatcgatagcattagatttttctggtctcttgacgcctttagcccatttaatctccaaaactctagggtgttgtctgaaccaccaattatcagccttatcaccagctaatcttgtacaatggattctagattgttgacctgcacccaatccgacaaccataccatttctagcataacatacggaattagattgagtatatttaatagcaatggtggcaaccgttaaatcaattatggcttgttcagtgagatttttattttgagaaacaatttctttgaaagttgattgattgattatggcatcgtttctcttttgttccaaagtcacaccgtatacttgtcttctttcgacagcttctggaacatagtttggatcaatttgtaatatgcagtacttacctcccttcttcttggatagaatggccaacgcctcaggctcataacctggggcaataacaccatcagaaacttctctagatatgatcttagctgttggaacatcaactatgttggaaagagcaatccaatcaccaaaggaagacattctatcagcaccacgggccctagcataggcacatgccaggggagataagttttcaatgtcggcaacaaaataaacttgcttttcaacatcagacaatgggatacccacagcggcaccagctggtgatacatgcttgaacgatactgctgctggtaaattcaacgaggcggataattccttaaccaggggccaggaatttagagcatccaacaaattaatgtaacctggtgaaccacataggactttgaaaggtaaactgtcttgttgactgacgtaagcttgagccggcttttggtgtggattggcaccataacgtagagtaatttgagcttgaccttcagagtattgtttcctgaagaaatctgaaattgcagcatcataatcggcagtgtgttcgaaagcctttaatgccaatctgtttctcaaatcttgagagatttcaccattactggataattcacttaaaaattcggagtagtcctttggatcagataaaatagtgactctagcatggttcttagcagctgctcttaatagagtaacaccaccaatatcaatttcttctactgcttctggaatagtcacacccaccttagcaacagtttctttgaatgggtataggttacaaacgacataatcgactttttcaatgtgctgttccttcaagtctttctcatcgctatcgatgtccctagcaaggataccaccatgaacggcaggatgtaaagttttcactctacctcccaacatttctggggcatgtgtgatagcagaaacgtcttcgattggaaaaccagcgtcacgaatcatacgagcagtaccaccggaggcgagaatacgaacgttcttctcgatgaggcctctggctaaatcaagtagacctgtcttgtcatagacggataggattgcggtttttgtgtaattggccatatttgatggtgatatgtgctttgatgtccaagctagcaaaactacttcaagggctattagttgctggtaagaaagattttaggtactacactaaaggttaaaacgagcgtacatttatatacatagatccgaacgtgatatgcacatccgaatattaacaagttatgagaggagtcaattcatttctgggcacatcagggtacacacattgtagggtaggatcttctttataaatgataagttgacttctgcaatgacttagttggcatgattaatattgttcgttccgctaaggaaaaaagagtcaaaaactgcaaattcaaattgcgtatgctgccaaagagcgaagaataataaaaaaaaaataagtcgaagaaaaggaacgatgaagtaatcaggttgaaaaaatgttcatagtgcattattattgatctatatacggttctaactatttcattttctatacctccataacgacagagtattttgtcttttccaggtctttcttctgccggccttggtgttgttgaatttgtgtcccttgttgatacccctggatttcttaccggtggcagtcaagcctctagcttcacgatgcttatggacgggattgcagatccagttgtaccgagcatctcttctgatagccttgtgttgaggatcaaccaatataacttcgaagtacttgtaagtagagtcttggttgacccagtaggagttcaagactctcaagttagcagcacgacggccaactctttcttcagcggtagctctcaaggatctttggtatttcaattcattgacaccttggttagttggcttaccgtaagtagcaccctttggaacaggtctctttctgttaccgcgtctaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccattgcttgtgtggtaggtaatttgtgactgtctttacggtagctttcgccgattactattgccgctaacttctcaagagtgaatgaaattatcaatggctccggttaattgaaaacgtggaaaagtatcgaaaggaacaagaaagatgttttccgggtaacgacatatggagcatcaagacagatacatctctactgactacatgtttgtatcatcatttgaagagattggagaagtattctagcaatcggtgcaaaaaataagagtaaagaaaaaagacgtttgtttccttaaaggagctggaggagcctgttttggatagcggcgtagtcgctttattaatttggttatactttaaacgcaaagatggcagtacgaaaccagcaatgcagtgattatatattccctactaaggaaagttgcgcatccaatgggaaacattttcctgatctgtacctttggcaacctgaatatgcggttggctggcaaataaggtagcgtggaggcggtgtttttgccacaaaccagtacgcccaatctatccctgcgagccaccgtaatgatgcaaattgcagtaaagcagcgcttagcctccagccgaaatttacttccgtcgaatgcacgttggccagaatgtctctcgtcccccttgtgctgcgcaaataacaacgcgttggtgcgttctggaacgcgaagattgcgaaacacgcctccgaactgacgtagcatagagtctttcacagtattgcctaatgcggaaatcacattgccatattggtgaaaaatacaatggctagtttgatctatttttgggttatggtgtctcgagcgtaaaaagtgaaaaaaaagtatataaacgatctgaatttaaggcagaattctgtttgccgctctcagaatgtactgttaattactgaggtctccatcaaacacaaaccccaacctaatcgcaaataacctgaataaaaatggccagcagtacttccacttccgcttccgcttcctcctccatcaaaactaacagtgccttagtttccaacaatgtcgttgccgcctcttccgtctctgctacttctactgctagttccagtgccgctaagaacactacttccagttcaaagaacgctgctccaggcatggttgcaaaccctgtttcctcgaagtacggtatcatcatggccgcatttgctgctgtttctttcgtcctaggcaccggtatttaagaagtttctaaaagcctttttttttccttctgcttattgtactatcaaagggaacgattgattaacagaaaaattacataaaaatcatatcataatggactcgcggttgacgcctagttaaaccaatgaagaggtgggcgaacttgtgggagttatatatatttaggccaattgggccattgcatgtttcctataatatattttaatataaaaatttatttattaatacagcaactcattagattaatcgagtggtggtaaggctttttttgctcgcaatgcgagcacgtgacagaaagtgagaatgaacgtctgacattgctagtgtcacgttcagaaaacgagaagacgggtaaaacaaaaatattgatgattgttggttagcaatatcaaattcattgaaggaggtcacaaccgcgagagaaagtaagatgtcatgtttttgaatatgaacctggagctcgcatataactctttccagtggcacctttagatttattttaactctgaaatgtaggtttttttttttttagacaagtcacgataagtagttgttgttagcgactttattcacagcatttttttatgtagcatttgtagaaataggggaattatatcggagtactcaagaaactaacgggcttctgagtaaaggggcttcccgatgtaatggcatccaaggtacttatctaactgatttttgattggaagaaacatttagaatgcaacctcaattgtgggcaattacgaccaatgacagccaaatccagtaaggtttcaaagggataatttactgagaaaacagatttactattctggaggcaggagtgatatattcttattcttcctatccatgggaataacgatgcacttttttatgggtaaggtgtgctcccagtttttcttaccaagaagtgtgcaattggtacggtaatatcgtatttgtttgcactgatgtacccacgctttagccatttaagttattacgaatctactctgtctatttttttttaccaactccctacccagagggaaaatgcgtatgcaatctaaaatactttatttcccattccgtgccttaggcaaacacaaatggattttggctgcataccgaggggtctaggtggtgatgaggtcgctacaacccaggatggttatctcgtttcttcgaatttccgcagcaaagaggacccttattgcagggatggaaccttttctgcacaaagcaaaatcctcaggatgtttctctcctctgtctttctttgccgagctccatcgtgctagcgcatcggacaggaagcagtgaaatacaagaaaagtatacaagcagtattcctgctcaagaacccagttttcagttatagtttccactcctttcaatagatgggaaactatatatccattaactaaaatggccagtcagactatctcttctcctcactagtgcctaatctctggtgtcgccactcctgctgctgctaattataagggcaaagtcagaccatcacttacattgaggtgaatattaaaaccagtgaaggttctgtttttctcgggagtatttccggcagtaacaccgttacttataccaaagagaatttttctgttggtatgattactgaccctgtctgctcgaagcacggtatcatcatttaccgttgtttctttcgtcctagatatcggtgtctcagaaactccaattgaagatgtacaggtgattaattacgtctttttatcaatctatttacctatatatttcaattttgatttttatttggcgagtgacatgtgaaaactttgcctatgaacctgaatagcgcattcatattttaagaacatggtagggtatagcagatgttctttaattttctttgactgcgtttacccggcgttttttgcttgactgaaaatcaaatgaagaaaaatagagatggtcttttctttttgtcatatccaagaacacgtccatctaattgattagtgccaaaaatcgcagggatataacttcgaaaatttctcaaaatggccaatttttttgttagactgtgggaaagtgtatttgaaccagggacctccccccagctgatcatcgccacacacgtatcttttgttgcactactactgaccctcatctggctcatctatgccacaaacgggaatatccacttctatgctcttttctgtatatcacttttactatggattaccgttatctggtttataaacgaattatcacacgtcaaattgaaggataatgatgagctggataaagatgccaataaaaaggacgacagtgccatcaaggaagacagcgaagacaagcaagaaagcgggaaatccactagtactgccagacggactcaagcacaatctaggtcaagaaaagcatagacagatacataattgactacataattatctctgttattagtatatcacagagcttccgggtaaatgtccgcaattgtaaatttttttgtccgcttcagggtctcccctgatattttttttttcaaaaattccttttttttaaatcaaattttgggctcaattatggacaaatgaagcacatgcaaagagttaacgcgtgcgactgaatagaacaactctttcagcatcgcaaacccttcaaattgtgaataaataggcatttcaagtaactgtgtcagcagcacattgcataggaattctgattttttgttttagtgactgccctccttaatttttttttttagttttacggctatagctaaatttggagctttctttcattaattttcaccgagctattaataaccctacaaaaagagcagagaggtacagcctgatccgataaagcagtgggataaaaagtactcaaagactatttataaaaagttcaaaatggatgcaggtttatcgaccatggcaacaagaaacggtcagtcttctgctagagttaaattgagaaataacctcttgaataatgatataggaaatattgacattagggatgaaacacctatttcaaggaacgggaatgacagcaatattaacatccagccttcttccgtgccgcagcagcagcagcagcagcagcaatactaccgtaatggcatgaatgaggctccaatacaagcgccacttcaacaacgtcaaattcccatgcagaattattcacaacagcaacgccagcaacaacagtataattttgagtattccaatccacatatgaatgagattcccctcatgcagcataacttcaccaaaccatcactaagcaataatcgcgataatgttaatggtaagaaagcttcctcatttacccagagctcattttccaattttttcaaacataagcatcaatttgggaagtcaaagaaaaacactaaggggacaggaggtggtggagatggtgatgatgacgatgaggttatcttggatgattctgcaaactccgacctaacattcaatgacattcagaccttcggtcacaagggcggtgacaaatatggatatggtggtgattccactcctatcattccaacattggtgactaaagaccgcggcaatatgagtaatactgagtataggaagtacattactaatcaaaggaaaaccgcaatgaatgccatggctaaacaaactaaaaatggtacattagcctcattgcctccgagagcaatgtctttgcaaagtttcccgaatggtaatcctttaatgcaagcacccactcctcatcctagatttcaaccgaataaaatggtgagcgccaattattcgagatcaaattcgttgatgagtggacctcccggacaatttcaacagccgcagcaacaaagaatgctaccgatgaacaactacaacaatcacccaggtcaattccagaataccccaccagtaatgccctctggacaacagccacctcagcaaccacgtactctgtcattaactaatggcccaagatattcaccccaaaatcctcggccattcgcaggtcatcagcagatatcacaaagacaacaacaacaacaacttcatccaatgtctgaaggctatcggacaatgtctctacaaagtcagaacgttccccaagggtttaatccatggtcaccaaatgacaacgatcgtaaagctgtgtccatgaaacagccaatcagtcaatcgtcaatttcctcaaagaataattcagcttattcaataccgaacgtacaaaacaactccctgactacattctctccgtcatctcctactgatgctacagcaatgcctaactctacaaaacaaggatcttcaccactaaaaaaacaagtgaacattgatcaacctattgaaaacaagggaaaactgaatgttttgcaattatccactcctcaacaaaacgagttaaaggaaaaagaaaggaagctagctgaaatggaaaaatctttacgtgagagagaagcactagtagaagaaaaagaaaaggaaagagctgagaaaaatactgaagcaaatgaagaggaggaaatttcacatgaatcagacgatttaaatttaagacctacgagtgcgctagagactggtttaagagatcttaaattggaaagtgaaagtgcagtcgccaatagagcgtccttgtcgactttctcatccacatttagtgattctccctccaagcaaagaatcatcaataccagaacaggtatgtataagctagaaaactctactgatatcaatgaatacgtgaccgcacaagagttcccctctcccggaaagtataactcaaattcggataatggcgaaatgaatacaacgaacgaggtcgattttgatttcaatactagtaaaagggcttctttgttacaatccataccggaaagagatcccaaaagaaatgtctcagatgctaccattaagcgacgtgaatccgatggcaatgacagaagactaagtaatgtcaacatatccatgaaccaggaaaacatcaacaatgatacttttctatataaaaaaaataatcgcgatggtcatttatcagcagtttctcatatgtccagctcttcccgtagatcgttcatctccaatacgctgccgttgaatattgattccgcctcagaatctgataattttgtaccgcatatggatggttcaccctccaaaacaaaatcagccccagttagctacgataaggatggcatgaatgcttcagaagaagacttcagttttgataatactttagccaaaccgtatgaaccgttatatgctaggagaggagacataacttccgccggatcaactagtggagaagatagctctcagccaaagatgataacaatatctggtgagcaattgaatttgataacagaaaacaaagaattaatgaatgagttgacactggtgtctacagaattagcagaatcgataaaaagggaaactgaattagaagaaagaatacggctgtatgaaaccaataattcagcaccatcttttgacgattcttcgagtgtgtctttttctgactttgaaaaggaactgagaaaaaaatccagtaaaattgtgcaattgatccagcaattaaatgacgagagattaaagagattcattgcggaggagcagttattactccaagaaaatggcaccaaaccaagttctatggaactagtagaaagaattgaaaacttgaataaacttattgatgagagagattcagaaattgaaatgcttaaaggacatttacaatagatgaatgatgtattttattgtatatatcgcttagtgcaccaaaatcatactacgtaagtataaaatcactttacacgtagaagatgcattttcagattgttcttgaaaaagttgaaaaaaatataattcacactcagcaacaggtgaaagtgtataatgggtaaaaaaggaaggacagaaggtatattgctaatcaaaacgactttggtatacgcgtttggggctacaattgcattttaaatatatttaagatgtttaatagaaaaagaagaggaggtatgttttaaaaccaatgttttccagaagtttcgttctagagtgtgtatatcaagaccaattaggatggtatttccattttttgtcagttagtacggtgtgacagaaaagtgtacttttgtggcacagagaagtggagaaacggtacacgtagaatacataacggcaagtaacctctcttattttactctccatctttactttgttttacattcctaggattattaagttggcttggttttacaaaaactcaattattcagtttcattcaaattactaacatacccaactttgactaccttgcatatgattttaccgttagacttcgatgaagatgaaaattaccgtgattttaggcctcgcatgcctaaaagacagagaatcccacctgttgtacaactgtgtaaagaaatgatgcccgatattcgcactattggtgaatctgttaaagcttttgaagatgatatcaaattcttgagtgaagctataatgaatgagtacggccatgaggactactttaataatgctttactgagcactttaaatgctgttgttgtggagcaaccacagaagcaagctgctatcgctctcttaaccatggttgttaattcgaaaaataatgttgccggaaagagtattatcaattacttcttcgaagaattacaaaaatggtgcaagcaaacatataatgatgaattcaagagtacgtcaaatgaaactgggccatggaacaagatcaagttaatcctgagatttttatccattctatcgcccatgtttttagttgatgaactaatcaatatctacaagagcttatttgaattgagtatcgaattaaacaatctggatccaggtaacagagttccattatctgaagcaatttacaccaatacattattaaatatcccgtatttgttcttttttaataggaataatgacggtttgaggacaaaagtggaggagttacttgcatacgttgaacaaaactatctagttaaaacaacggatataaacctattaagagaatacaatggtgaacctccatatgaaatggtagaacttgtccgagtcgtattaccaaacgtcaagaaggcgctaatcaataacttggaacagctgaatgaattatttcctgattggaatcatttattaactccccaaaccggtgatgaagggttcaatgacgctttaacccttccatcagtagatgatctaaagtcttttgtgcgcttgaataaaaactttggttcagttgatagcatgtggaagacgccaaggtatgcttttcatgtttacttgccaaactccgctggtaatttcgaaacagttgtaccaatcagcacttatgctggtcaattattcaacgatatcattattgatctggtggaaagtttagaattcaatagaaaggaagtagctagacaagtgataactttggatctttttttcaaagcaggtatatttacagaacctggtgaatctattgcccaattaattgccacttatgaagagaacccattggctcctacatttaagatagaagatttggctattgaaaccattttgggacttatttttaaattacctagtgtttcccagccttttgcatacttttacactttattggtggatatttgtcaaaattctccaaaagcaattgctcctgtctttggtagggcctttaggtttttttatagtcatttggattcattagattttgaactaaaattaagatatttggactggttttcaattcaaatgagcaactttaatttttcttggaagtggaatgaatgggaagacgattctatcaaatttggcaagtatttttataatccaaaggtaaattttgctaaaaatttgattcaaaaagaactacggttgacctctaacttttcagaagtagaggacagcctaccacaagaattcacgaaatatttggatacttcttacattccaagagatcaactgattgactactatcaatcattattcaccggttatacggtagaagaagattccgttaggaaaaatgatctatattttagacaagaaggtgtacctatggaaaacacagtccgtaaaattttagattatacccacaaagcaaacaattccagggaagttactgaattagaaagtattctaggtgagttaaggaatgagtatggttccataatttccgactttaacagatttgttatcatattgttagtccaggccgttacagactctggtagtagatctttatcacatgctaataaatatattaatgatttaaaagaagatctcaaaaccatatttgcgaagattgaattggatatcgagacaaaagggtatatcataattgaagccgtcctaacattttggaacgccaaccctcagacaggtttcttagtagcagatgcattcaaatatgcaggtttaattacttccagaaccatttttacatttatatttaacgaaactggtttgaagaataatggtttgattgaagctacagcaattgaagcggtctttagaaatttatctcaacaaatctcggaagagaacgaaagtggaaataattttgagttcgttttcgaaagattatgtaccatcgccaacagtactatagacttactagatgtcaatgctgatgaagatattgagatacctaaagtcaacggggaaatggacatcgacgatattgaagatgataaactggatttgaaatggaaatattttacagtgattgggtttattaaaagtatattaagaaggtattcccacgaatatcgtgagttagcagacaaattcattgccaacattgataacgctattccacacgaatccactaggagaacaatttcgaattggattcaagaaacaaaggaagtttaaaaagattcggaggatggattacattcgttatcactccgctttttaattttcaatcaatgttacatacctagcgtaattttcctatatataaaatatcagctttatataaatatattattgaaactgtacctataataataaatttaaaattaagtaaatacaaatgcttcaaaatttgttagtattgttttcttcaatcatctttacttaattgtcatcgcaataattaaattaatattttattgttgttgcgtatataatacaacctgaatggtatgctacactatgttacactatgctattgatcagagtttctaatgacgaattacacttctataactatccgctttggaaagtttgagacgaagggcgttacaatcagaatccgtatccaaaggatgttcttcagaattagtcagatctacacctgatgaaacatgccttgcgacagtacttatgctactttctctaaccaaatgtgtaggcggttcgggaaagtaatgcatatcatcctgcgcgtattcgttttcatcaaatgggtttattgaatattttgattcagttcttccaatgttatttgaactgccatttaatttaaaattatgtaaatttgcaaatgaagtgtctcttgttaatgacacttcaccgaaatagagacaaaacttaacaaactttatgaactggtctctagtaacgtccttccctgaaaatctaattgtttcatataaatcgataaactccttcgccttttctaactgaattttattggcgttgtgattaacaaattgtgagttcaccacgtcggcaaacgtatcttctagattcattctaacatctaaattgttcagaaacaatccatggtatttcagtctatctgttaaactttttatacaatcagcatagtttaggtattctggaaataacttttcatctaatgggtagtcacatctcctcgggggctcaagtccgtcgtgaataacagggtctttaggttttttgagaagaattgttaattctttagatctttccatgttctgcagtactgcttccctactagaacgatgcgggagatcagcaggtgtgatcggaatatatcttcttggtatatcttttaaacaactcttatgaaatagcattcttccaataataataaagatacaaaaaacgccaaagacaactaaagcgcctacaacaatgaacgtattaaaggcattgttttctgatttagaagcttgtgcaatggaatctatgggtaaaacaactgaaaacccaatcaaaagtatcaaagaaacgaaaagggaagctttgtataaccacgacttgagttttgcgaatccggacatctactgctaagtatggacactcgtgtctatagatagtatcaggccaaagttgtatagcggtatctttttttaaataaatttcaatgtgttttcctctgtttaacctcccactttctttgatgctcaagagcaataactttatcgcaaaataacaaaactttaatatgtgttgtaattttggctaaacccagttcaacatcaccacaaaagaaggtttcctttatgcccttaccctttctgccttcttattctagaatttgttttgatgctatatttgtttggtccttgttcgtcatcgaaaaaccggcccaaaaacggctaataaaaacgtgaacctgttttaagtcttttgctataaaagatatttatactctaaaaaaagggaaacttttgcagcaaaataaattttatacactagttctctgttcttaacttggtcagacaaaattcgtccgtttgtagttgtctgtacaggaattcatcgagcgatattctatcctgaaatacatatgccattaagttacatcctgaatagattcctagtcatctatcagcaaatattcatcttttaatttgaaccaattccgttttgttccatgtagtttcaaccagctattcaatgactgcaagtaaatttggttattctccccaatacagttcaagtgcttcaaggtcaaaataacatcattgactctcattccagtcacgatggaaagatcctccagggtcactttatcataatgggcgaggtcaccttcaataaggtgccaacagagtatctgtgaccaatatttcaagtacccgattagtccaaaaggtgataacggtacttctggccctgatattacaccttctaattgggatagtttgtatgaaaactcgataagtaaaaggcctaatccacgtcgttgatatgggggaaatatcaagatgcacgctagattattttgctgatatgacactaaatctttcgaaaagaatcccatcggctttgttgatccagtttcataaactatgtaaaattcataatgatctactttgaaatacatggatttattgtccagatatagcttagtgaaaagacaaagacattggcaaaagagttgatacttggatccttttactcttcttattgtatattcaggactcttgtattttattttgcctggaacacgatattgaaatggacaacttgcaacatgtcctacaaaccgcgtctgatcatccgtgtatttgaagcagtattcacaaacgaaaagagtgtctagccagtattggctgttagaaacagaggaaagctgacccttggtctcggagcaccctagcctttttgtttcaggatcgaaataaacggcgctcccataccaagtagagaattttttattcagtccaaactgaatctgtcttatgttcctttcgttcagtattccatacagcatctctttttgagtttttttaatttttgctgagggcttattcttgccttttccaccattcttctttccttttagcttctgggtagtcgctgtgagtgattgacctaaagatcttgccattttttttgcgagtgaaaacaaaaagcaactagaaaataggagccaccaatatcaaaaaatcaaacttcaatttaacagattcttagagcgctacatactctatccagttcgatatggacaagacttaatgatttcatcatctcttctgattaacgactctgttattcttcatatttacgcgcctaacatatcatgatgattgggtgttccgaaaattttcattggcgatgagctgagtattgaaagctcattatagtattagtatattattgttaatagcaagtgctatatgctataaaaatgcaattacaacccaatactaataatagagtgtcttaagaaatataagtatgggtacttacagaaaaaggtttaatgaaaaagccagatccggccatatggccaaattaaaagagctgaaaagaattaggaataagcagttcactagacaggatgaaaacgatgaaagagtagaaaacccagattcagctcccgctgagagttctactacggagccaaatgccaatgcggaaattcttgaacctctcactgaagaagaaaagaaaatgaagaaaagaaaactacaggagttatttaccccaaaggaatcgaaagtttcgagattgaagaagaaaagactggataaatttattgaacatcaattaaaaagagaggaaagaaagacaattattggcaaacttcaagattataagatagatacaagtttgttgacaagctctaaaaggttaggagagggcaggcagactaaaaaggaagaattcaaagaagcactgagtttagaacgtcagggaagaggaaatgaacaaacaaaggaaatattatacgaagaatatgaaccaaaagtttgggatgaggatggtgaaggagagagctctgaggatgatgacggcgaagatgatttcgaggcttcatttggtagtatgccgaaaccaacggacaatgaggagaagaaaacatcaggttttattgatcatagaccagcaaaatttggtggatctggtcttagctttgggtttagcaatataaaagtcataaacaaagaaagcaaaactccgaagaagaaatataattggagacaacgagtagaaatggaagaattgaagaagcatgggaaagaagatgaaatggatttcgacacgacatctgaagatgatgacgaagaggaggatcaggaagaagaagacaaaatgcatcctagtgaaaacccactcgaagaagttgaaagcgcagatagtgaaactggctcagaacaatttgaccaaaatgatgttgctaacgaattcaaggattgggccaatcaagaaataaaaaaattggaaggtagagatcaagagctagttactcccactttgaacatcgattataaaccgataattagaaaggaagatttagatgatggtctccaagaagcttatgttccaataaacgagaattccacccgtaaagccttctatgttgaagttagcagatcagatgaaattcagaaagcaagaattcaactaccagtatttggtgaagaacacaaaattatggaggctattcaccataatgatgtagtgattatttgtggtgaaacggggtcaggtaagactacacaagtcccacaatttttatatgaggctgggtttggtgccgaagattctccagattacccaggaatggtgggtatcactcaaccaagaagagtggccgctgtgtccatggctgaacgtgtagctaatgaattgggggaccatggtcataaagtaggataccaaattaggtttgactctaccgcaaaggaggacacaaaggtcaagtttatgacagatggtgtcttgctacgagaaatgatgcacgatttcaagttgactaaatattcctccattatcatagatgaagcacatgaaagaaacattaacactgatattttgatcggtatgcttagccgttgtgttcggttaagagctaaactacataaggagaacccgatcgagcacaagaagctaaaactcatcatcatgtcagctacattaagggtatcagatttcagcgaaaacaaaacattgttcccaatagcgccccctgtcttacaggttgatgcaaggcagtttccagtctctattcactttaatcgtagaaccgcattcaattatacagacgaggctttcagaaagacttgcaaaattcatcagaaacttcctcctggcgctatattggtgtttttaaccggtcagcaggaaattacacacatggtaaaaaggctaagaaaggaatttccttttaagaaaaactccaagtacaacaaagatttagaaacacccgtttctaaaatgggtatcaattcaaaaacaacagatttggaggctgaggatatagacttcagtgtacaagttatcgatcaagataagttcaagagcgcgataagatacgaagaagatgaaggtaacagtggaaacggtgaagatgaggaagacgaagaggaagaagggtttgaagaagtcctaactgaagggcaaacagctaacgatcccttatatgtccttccactgtattctctattaccaaccaaggaacaaatgagagtctttcaaaaacctcctcaaggttctaggctttgtattgttgcaacaaatgttgcagaaacatcgttaactatacctggagttagatatgttgttgattccgggaggtctaaagagcgtaaatataatgaatcaaatggcgtacagagttttgaagtgggctgggtaagtaaagctagtgccaatcaaagaagcggtagagcaggtcgtactggaccaggccattgttaccgtttatattcgtctgctgtttttgaacatgatttcgaacagttctctaaacctgaaatcttaagaatgccagtggagagcatcgtgttacaaatgaagagcatggccattcataatatcattaattttccatttccaactcctccagatagagttgccctttccaaggcaatacaattactgcaatatttaggtgctcttgataataaggagatgattactgaagatggtaaaaaaatgagcctgttcccactttcgcccagattttccaaaatgttacttgtttctgacgaaaaagcctgccttccttatattgtagcaattgttagtgccctttcggtgggagatccttttatcaatgaatttgagttgggaataaacgaaatttctagaaaaccaaatccagatgaaaatctagatgaaaagattagagagcacgatgaatcaacaccaggtatggatcctgaactgaaaaaggaattgcgcagtaaattctataaaagcaggagtcagttcagtaaattagacaaatttagtgacgtattccgtttattaagtgttgtaagtgcaatggactacgttccaaaggaacaaaaagaaatattcatgaagaaaaattttttaagaggcaaactaatggaagaaatagtaaaattgaggaagcagttaatgtatatcatcaagtccaacacttcaaaagaaaatattgccgtagtaattaggaatgaagacttgaaaagtgatattccaagcgttatacaaataaaactattaaaacaaatgatttgcgctggttttgtcgaccatgtcgccgtaagagcagatgttttatttccagatgatgctaagataaccaacagaacttccataatcaacattccttatattcctgttttggccacgagaacaccaaatatcgaggactgctttgtctatatccatccgacttcaattttaaataatttgggggaaatgccacccaaatacatgctctattattctttgcaccttggtggaaataataaaacaaggatgaatactttatgtgacatcgcaagcacccccttagcgaacatagcaagaaagggtcttcttttgacatacagtaaacctctgactggtcaaggcttgaagaccgttaatttatcacctacggaacggtattgttatgtggttcctagatttggatccacagttgacaacgatctcaagattggttgggatttaaatcctatagcagtgcatcagaagaagcaaaaaggccggtggacagtcattaagtttatcaccagaaagggcttccagaccatcacaggtgaagagaaaggaaaaaaataatgcgctggtattatagaaatagagtttcattatataagaacatataggaagaatacattattcctatctagggcatcaaataattgcagccacttaatgttaccttccttcataattcaaaacattatgttctatagcactatgtattttatgtcattatatacgtagtcaataactttatacgttttttttattgaacaaaagtaagaattgcttaagacataataagaggaaactcatcgaaccaattcaaaacggattatagatttatcataccagatacgtttatcaggaggcttgtataatggagcacagatataacgtgtttaatgatactccacgagggaaccattggatgggcagttctgtgtcaggatcaccacgtccatcttatagcagtcgtcctaatgtaaacacaacacgacgcttccaatatagtgacgatgagcccgctgagaaaatccgacctttacgcttgaggagctttaaaagtactgaaagtaacataagcgatgaaaaatcaaggatatctgaacgtgacagcaaagaccgctacattaatggtgataaaaaggtagacatttattcactgcctctaatatcaaccgatgttttagaaatttccaaacaaaggacatttgcggtgatattgtttttaataattcaatgttataaaatatatgacctggtaatacttaaatcggggttaccgctttcgggtttactgtttaagaactatcgatttaatttcatatccaagtatttcattatagattccttcttcctgtatgttttaccatcctttaatattcctaggttgacttttaagccatgggttgtttatctccagattttagctatgctactactgaacattttcatatcaagcgatcacgagttcgttttgatttcattaattatgaccacatggagaaaactttatacgaaagaattaagtgtaacaggttcggccattaaccatcaccgtatttttgattcttctgctcattttaagggtgctctaacaatcaagatcctacctgaaaacacagctatgtttaatcctcttcatgaatcatattgtttgcccatggataccaatctttttaaaattaactcaattgacgtacccatcagaataaactcaactgaagagattgaatatatcgagttggaatatagagatctttacacaaattcggtagagttacggtctttgagtaagaaagacttcaaaatcatcgataaccccaaatcctttttaaaaaaagatcagtcagttctaaagtcacattcaaacgattttgaagaaggcagtacaattcgttatttggctgtaactcttcaagatattggcttttatcaaatcaaaaaaattgttgattcaaaaaaacttaatttaaagattcaccagtcacatttggttgtaccctactgtccaattgcatctattactggaactggaagcaatgatagatgtattggcgattcagataatgtttcatttgaaattcaaggtgtgcccccaatgaaattagcatactctaagatcgttaatggtcaaactttttcatatgtagactccagcttgcaaccagaatattttgagtctcccttgcagtcaagcaaatccaaacaaagttttactcaaggagaactaaacgatttgaaatggggaagaaaccaacctgttaatattaatttagactcttccattacccaggacggcaaatttgcatataaaattgataaaataactgatggtctgggaaatgtcgtggattttacatctctccctgaagaattaaaaaagcgctatgatctatcttataatttcaatgttcatggggttccacgtgcagcgctagaagaaagatttgatccaaagtcacccacaaaaaggtctattgccatcgtgtttgaagaaatcaaaaactggatttcagacattccatatgttattagcctatcctatactgatgcacaagacaagtcgaaaaagataatgaatgttactacagattctttgaccaaagtgttgcaagcggatcttccggggtcatataacttagaatatattgaatctaagttttgtccaggtgaaattgtgggtaaatcaaacgttcttgtaactatgccagttgcacctactatggaagttaaatcatttccaatattggaccagtgtgtgggacaggttggtctaaactttgaactatcttttactggggctccaccatactattataacactaaaatctataagcttgaaaacgatgaaagaaagttatatgatgcaaagagatacacctctgaaggtacgagaaatcgcttcagctatagtccacctaaagaaggtaactatgaaatcgtgtttgatactgtttctaataaattattcactgaaccaatcaaattggaacctgtaaaagaatatactttcaagacatcaatgagggtgaaaccaagcgcatcactaaaattacaccatgatttgaaactctgtttgggtgaccacagcagtgtcccagtagcactaaaaggccaaggcccttttacgttaacatatgatatcattgaaactttttctagcaagaggaaaacttttgaaattaaagaaataaaaaccaacgaatatgtcattaaaacaccagtctttactactggtggtgattatattctatctttggtttctatcaaggattctaccggctgtgtagttggactcagccaaccagatgctaaaatacaggtgaggagagatattccatctgctgcattcaatttttttgaacctatcaaagaagctaaaattaagcacggttctgtcactgaaattccgctcaaattaagtggagaggggccattcaccgttaagtttaaacacatggattacgatggaaacattgtgaaagaatttgaaaacaaatttcagaatagttataagcccgctttgaaagtaagtaaagaagggctttaccaattggtcgatattcgtgactcaagttgccaaggtaaagtgattgaccggaacagtctgtataaggtatctttcttggagaagccaaaatttgcaattcaagacaatcatcacattacaaaagtaacggaaaatttattttctaaagaagaagtctgtcaagggatggaaggtacggttgatttggctctatttggttctccaccattcatattagaatatgatttgatggcacccaacggtcatatttctacaaaaaaaattcaggtggcaaccaaatacgcttcactgaaactgcctaatcaaattcctggagagtacataactactattaaggccatcttcgatggcaattatggtgaaagcgacatacattttagagaacatcagtcggagctcataatcaaacagacagtgcaccccattccagacgtcgcatttgctgatggtggtaaaaccttgcgtgcatgtgctgctaatgtagatcaaatctcatttttggaaccaataaatttgaaatttttacaaggcgaaagcccattttcaatcacctttagcgtttatcacgagagtaccagtaggacagatcagtataccattgacaacattgactcagagaacttttcatttgaaaagttatatgaagggatgaagttaggtaaccatgctattactattgattctgttgttgacgcaaatggttgtgttaacagcctcatatctggaccgcgtaatcaaattcttgtgtcaattactgatgcaccaaagatacatatattagatccttctaccgagtattgtgttggggactatgttgcatatcaattaaacggtgtggcacctttcatgattaagtatgaattcaacggtattccactaaaatctaaggaacgcagctcccaatttgttagattagcatctgaaccgggcattatatctatcacttctttacaggattcatcatcacaatgcattgtcgactttacgaaccctaaattaaagagtgaatttgatgacttatctttaaacatacatcctattccttccgtaactgtttctcaaggaaattacgttactgaagatatccgcgaaggtgaccaggctgaagtaatcttttcgtttgaaggtaccccaccattctcactaacttatgtaaggacagaagagactgatggaaaacacggcaaaaggaggtcgcaggttgttgagacgcataaagtcactgatatatattctcatgaatacaaggtaattacaagcttgcaaggtacctacgaggcgattgaaattacagatgcttattgttttgccaaaaatgatctttttttcaataactaaatattacaagaaagtctgatgaaatttttctttcccgcaatatttttgtacaattttaatgtataatatatctctgtacatcagtattaaaatacttaagaaagcgaaaaagacgcctgtattgtttgttgttctttttcttcaaaattatcaagacgctcgattcaattatcttcgctcatagtaactcgaaagagtgtaggtgaatgaatagaaaaagagagcgctgagacctttgtcctttacggtctatagaggtgtgttaaaagcagacttttgaacatccacagaaattggctcaatgacctatccgaaaagaatacctataaatgcgtggtctgaagttcatagggtggcaaggccactaattattactttcgacgcatataatacactatacgccacaaaacttcccgtcatggaacaatactgcattgttgggcgtaaatatggtatcaaggcgaatccttcaactttaacaaacaattttccacacgtttttaaaaaactgaaggaagactatccccaatacggaaaatattctggtatcaagcccgaacaatggtggtccatcttgattaggaacgtcttcgcaccaaacgaaattcccgatgagatgataaatgaaatattaatgcggtttgagggcttcgattcgtattttgtttatccagatttgatcaaatttttaaaggatttgaagtcaagacatcctgatgttatcttaggaatagtaagcaatactgatccaattttttacaaattattaaagaatattggattatttgagacattttccggtcacatttatttatcatatgagcttaatctcgccaaacctgatagagccatatttcaacatgcgcttgacgatattatatctaagcaacctcatttactcgaaaagtacaccagggaggaaattctacagcattgctttcacatcggagatgaattaaagaacgatctcgaaggggcagaagctgccggttggactggtatactgttagatagaaatgataaatacgggtttctttcaaactcgattagtaaaccaatgcgggacgaatacaagctgtcaattgataaaatagataataattcaataaacacttgggaagccagtactaagcaaactgacacgttacagttgagtgaaagaaagtacgttgtttcgaatcttgaggttttagaggaactgtttccctgagcgcctaacgttacagtaacaaatatgtatgatagatattattcatatccgccagtaatatttactatatctttgaatgggtttgtttattaataatctactatgtgtaaatatatgatccaagtattatacagtttagacactgattgttttccagacgttcaaaccgtcagtaccggtacttactaaacaacctgggatttgcttatgccatttgacatctttaacttccttttgccagtgaacaaacaataattgtggtggaatttcttgtagctcttttgtttcggcggcctgttgtttaatttcctcatcgtcagcttctacagacaaatcccacaaagtcacagtattatcttctgagcctaccgcaacgatagactcatctaatgggttgaatgcaatggaagtaatggctcccttatggaagtcatattgagcaaccggttggacggcgtcagcattacttggcgtaaactgtcttaaatcccatactccccatgtaccgttatcgtcaccgcttgctagcaagtaaccaattttatcactccaacttatgacatttacgtcagtattagaagctttaacagagatagcaggtttatgtttttttgatcttgtgtcccaaatccttatatatccatcacatcctgcggttgcaaaaacggtggattcagtgcgagaccactggatatcttctatggatttattgtttgaaacagtaaatggttgtttatcagtcacccatctcgatgtgtgcctttgggtaaaatatatttgtcctgagcaatcacctgatagtaacgcaccagtcttgatcaatggtgaccaatccaacccgtagccttcaacattcccatgattttttacagtgtgaataggacgcttaacagacttcggaatctgataacctggtgtggaaaaagctttgctttgtggagctagatcgtatatataaacatcaccattttcgctcattgtagcggttaacacctcttgattagaaatggcaaaaggagaaacctttaatctattggttgtatctctcaatggtatattttcattctcaatgactggatccacatcatcttcatcatcctcttcatcatcttcaccttcattatcgtctttcaaaagtgttttcgctaaattagaaagtgctagaaccattagttcattctcctttttcctggaagattgagtagccgtggtcaacaaaatagactgtggatagtttctacgttcagaacctagtgtatctggaatgacatctaatgtcaagcatggccatggcatattgacattatgtagcatttcataaacagtgggatcagcctcaaggacttcatctggccctaatggacgagacatatggggtaagtaaagctcctggatcttttctttgttgccttcggattggtccttttgtactaaagtttcagcttcttcttgctttttcctaaggtcatcttcgtcattaatctcatcatcgccatcaatttcaataatttcaccatcactatcaaattcatcactcaattgttcttctaggtcattcatgggagcatcttgctcttcagatgcgggaatagcaggaacagagtgagattctgttttagcagagaccactctatcttgttcctcgttgacctcgatagaccttttcgacattatggtgctatttccgtgtatatgaaaacggagagtaggtgatataactatttacctacaaattcaaacaactacaatccctataagaaatgatcatctcatcgctaaattcagttggattttattttctgtatttttcgctgaaaggaaaaaaattttcacggctcgaacgaaaaaagaaacgtgatcacgatgtaagtacaaatggtactccattttgaagcgtctacgttatgtagatgatatcatacttccagttgcatatcgtcagtaacctcatctttagactgtttgttcttcttcttttggttttttttcgctactttccttagtttttcttcttcaataagatttgatctattcgactcaatatagtttacaaaaaaatcaccatttttggtcttctttgcttcgttaagtgtagcttccacattattaaatagttctacccttgtcttggccagtctgtttagtattttgttatctcgtgctccgcattccatttttctacattgtcttagagacttaaatgatacttcaccgggattcatatacctgttttttctcaaattatgccatggtgttatcaagatggtgcattgtggcattttgtttccttgaatggattctgatttacatagctgcagacagtcacatatcacttcttgcggtatatcatcgattgttttttcatttgggcgtaactttaaataaacatgaccacttgagtacttatccgcgtgaaaccaaacatagtttaactccctatagctccatttgataagtagatcgttttcaaacttatctttgcccatcacaatttggtaaggtgttgaatactcagttggttttgattcatagaaatacaccattgttattgaaaagttgaatttcaattgagccttataattctattcgctcactttctaaattttaagtataaggcagtcctctggtctacagagttgttttgttttttttatccaagttctttgtttcaatcttattgtagtttttttccatcaaaaatattaaagcctcggataatctatatcctaacctaaatataaattaagagtataaaagatgaaagtaaatagcatctagcattcagaaaaaataagaagtctcttttcaaatgattgatcgagcacaacgaatgttttcaaaccactgttaatttttttatagatgtaatgactacttatatgttctacgatgtgattttgtaggaataaaataaaattcagtttaccgtctgcatattcataaacacttaaatgactgttaaagtattcagtattttaaataataataacataaattattaatacatacctaaatacgaagcccattttggtgggttcctgaaagaatatcaacttttttttactaatagagaatttcgttacaaggtgggcggctaacttataaaaagcaaaggagaaggttttaacatatcgtcaagttaagtttgaaagagagaactaaaataaaaaaaagagaaaaatgtacgagtactgctcagttgtagtaaagaaatactccaagtatacaattccctccttcgctccaaatggttttcaatcaatgcttgagcctcctcagatagacaagtggcaacacctttccgctaactgcactctccaatttcgggttcttctaatggactctagacaaattctgatcaatgtgattctcaataattcaacacttctcgaaaatattcgcctgccgctgggagataatcaagatttaatacaattttcatgtaaaagccccataatctcttgtaaatatatctccgaagaatttggacccagaatgttaaggaggtttcagatgaatttgccaaatgacgttgagttcaacaggactgtagtttctttaaagaaccttaattttgttttaaggacagctaggacatcaatagcccagagtacaataacaagccaggtgcaaggcaataataacggtacaaaggtctgtttcacagaaggtccaaaagttagtagctacacaaatccgaacacgcaatttcaaactcaaaacatgattatggatttcagtcaacgttatcaggaagaatctgaaagagagtcaaataatcgttcaaatataactttaccacacgataacattcaaatagcacaacaaatatggccaaacacggatttaaatgtagtacactcttcacaagacctcaacactccaatggctacgcaaactgttttgggtcgtcctgagtcgctaattgtacagccattggaggtttctcaatctctaccaaacactaccaactgccttcctaatgcagaaaacaaaaagaaaaaagtcgacaccacttctgattttacttcaagaaaggagattgctctgtgtaaaactggtttattagaaactattcatataccaaaggaaagggaaagtcagatgcaaagcgtcactggtttagatgcaacaccaacgattatatggagccccgggaaagacaacacggcgaagaaaaataccagtaataagaaaaatattgatgataaactaacaaacccccaaaaatctggaaatacacatacccctgatagaaataaagaagtgctacctaacggcacacttaatgaaacgaggaaagaagcatcgccaagcgaaggattaacgataagagttaaaaacgttaatcggaatgcgtcaagaaaaatatctaagcggctaatcaaggaaaagttgaaagacgaagaattcatgaaatgggtatgtatgcatttgcaagaaactgagctgtttccccctcttatccactcattttctctgacttggcaaagaaatactaactaacaacttttgccactacaaatatgaatgaaaaggttaataaggttgaaacggttctcaataaaatgttcgaaaagtgaaccctttttttgcaattcctttttacactagccacgaagtaaaatggaaaagtaaacccgagtttcggcaatatcgctaagcaagaagagcaagctcgtttaagtaagcctttatgaaaaaaaaaacaaaatataaagcattataaaaattgaatcacatcgcaaatctgcaatatacttggaagtgtttatagcaaagtgtggtatagaaaaagaaccaaaggccggtatgtcgttaaaggataggtatctaaatctcgaattaaaattaataaataaactacaggagttgccatatgttcatcaatttatccatgatcgaataagtggtagaataactctctttttgatagtggttggtacgcttgcattttttaacgaactgtatataacgatcgaaatgagtcttctacaaaagaacacatcagaagaactagagcgtggaagaatcgatgaaagtctgaagcttcatcggatgctggtgagtgatgaatatcacggtaaagaatacaaagacgagaaaagcggtattgttattgaagagttcgaagatcgcgataagtttttcgcaaaacctgtgtttgtatcagaattgaatgtcgaatgtaatgttattgtagatgggaaagaacttctgtccaccccattaaaatttcatgttgaattttctccagaggattatgaaaatgaaaaaagacctgagtttggtactaccttgcgtgtattgaggctgagactttaccactactttaaagattgcgaaatatatcgcgatataattaagaatgagggcggtgaaggggcaagaaagtttacgatttccaacggtgtcaaaatttacaatcataaagatgaactactgccattgaatatcgatgatgttcaattatgtttcctgaagattgatacggggaacacgataaaatgcgaattcatactatgaaagcttccaaaaaaaaaaaagaaaaatcaattgctaaatgcatacatgcaggtaggcacacacacactcacacacacacacgcacacacacatatataaatatatacgtactatgtatgtcagttttcgaccctaggaacccctatttggttgtgatgaagctgattttcgcaccaacaccacagtttcattatttgcgtcagtcttggttcatagggaaattcggaagagtagtaattattgaattctaaacctttttcctttccatttgaagaggaaagcaattcagaagtttgattccagtaatttttattttctaagttatgaaaagttgtcgccgctgaacctgtgccaacatttccatccctttgatttagccaaactgaattagcagcagccgtgacctcgttgcttgacatcttttcgttgataggttgatcagacgaaatgtgagttatttttgtaccatttgaaccattgacgagattgttgttatacaccgtgaagttctgcgtaattattttcttgtcggaatttaacaaatctggaaatttggaattattattgctgatctcaaattgaatccttggatgaataaacttcagcagcttctcattaaccagatctgctatcttagatcttagagatatcgagtacagattttgtaacgatttgggcagcttaatgctgccgctgtccgccgaatctgacaaggggaaaagcagcagagtcattgctaattctaactcttgcatctttttgacacttgacgaagcctttattgcaagtttattttgagaatactgaattagattgagtataaagtcgttggaatccttggtgatgttctcctgttgatggtgacttcttatcatctcgatcaaattcagtaacagcagtttgaagtgtaaatctccatctatgtcaaactgctgctgctgctgctgctgcctgtcagttctacccgtgtaacttcccgtagcattgaaagtctcttccagcacctccagcccgaagatagagtttatctcctccatcgcctcattgatgcgccccagcttaataagatgtttgatatggaaacgctccttgatcttgtacaaatcattgaaaaccgcaatgtctttgttgttccgtataaatcccagctccttggccatcctaatgctcgagtcttcatatgccatagaaacaaagtagttcaacagaagccgtggcagtgtgggctctatgggtgtggtctgtatggtagcaaatccctcgtcctgcgagccgccactgctgttgggctggattttcagcggataatgtattgtcttatttgcatatagctcgcccatggcagaatacttggccacctgctccttccattcttccttcgtgaagcacttctttccatacgtaaagtctttcccaccattcttgccttggccgctgcaagatccgctctttgtggtctcgttactaagagtagatatagtcatttctatttgttaccacacacaaatatatcttaatccggctgatatttgcctctactgcccctttgcttgcaatttaatgaccaaattacacatgttagcttcaagaaaaatgatgtaccatcaaaatgtctcctgcaacgaaccggggcaccgcgccggcagagtcaggaaagcgagatcgacactgatagtgataaacagcaacacaatggagcgattaccattcactcggaacggatccggacaacagccaaataaactccgggatcccaaaaagggccgtacacacaaacccaagccgagcgaaaaacacaaaaaaaataaaacagggaaaaaaggagcgcaagagaaaacgcacaggagtagcagcagcagaaaggggaactaatttggtttttccgtttgcttatttttatttttttgttgagtcatgggcacgtcaccgcacaacagcgccgcaggcctgtatcgctacgcgtctatcactgcgaaacatcgctacttctgtcgccgcgtcgacgctggtccagaccacaaaaggatgcacgatcagaagcactgtaccctgcagagttggagatagtgtaaccgtgacttcatttttcaagcgtggtttcacattctttttgcaccgcccttatctcagatatagtttcgttcggttgctttgctttccccaactgaaggtgctggatggcggtttttccggctgctgcgattttccctgcgcggggcccggcgcggaattgtgcaaaagctaaaactcaacggttattttgaaatataaggttataagcaaatttcctaaatttgcttaattgttaatgcagttgttattgcattaagacattcggctatcgtttcctttcttcgtgtcggcaatcttgtataaaaagttattttttgagtttcagtttcttgtatatcttggtatatattgaaggaggattttttctttcctggtccttttacttccttgcgtcctctcatatttcttctatttccgttcacggcgtttttttattttctccatctactattagtgatttcctttgctctaatattgttttcgttcatagtgaattgtttgttttcactttaataaagggcttttacgacttgtctcaaaaaatttcatcgagatgcaagcccccaatatctaccccttctctcaaacacagccacaagcgctgcccgggttcacatacggtcctccacaacttgtttttgaccattctgctccgagagtagatcctttgcattctactgtaactataaattctccattacccttgcagcattataatggaccgaatgcccatataaacagcgcaaacaacaactacgcatactactatcatcatcccaacaataatgataacaacaacaacaacaacaacaacaaccatagtaacaacactataaaaaataacaacattaattctgttcttcccgccgttaatattcaaatacccaacaactcacattatagaaatacacaccaaattccttctgctcctcagcggctggtcagcatcataccggatccccacatgccgcccaatatttctcactttcagctaaataatattcaccctcaaatgcatgctcctgttgctactgatattcatttccaacaagtaccagtttacaataaaaccaataatggcattggtattgataacattaataacgataaacccgtaaattcgaatcagaatgaagtgctggacaatattgatgaacgttcctgtcatgaaattaacagggtagtttcattttctaaacattttgaaaacaacgaacttaccaccacagcaaatgatctaaacattcaatctactatggatgaattagctaaactgaaatctttatcaaattctacccatttcaggcagagtattgctactcagaatttccattctttacaaaatcatatcacaaccatcgaaaaccgtctggcttctttacttactgacagacaacaagagcagcaacagttgaagcagcaagagtctgaaaaggagagctcttcaccgttttccaataagataaagttaccttccttacaggaattaacagactccatctccacccaacatcttccaacattctatgacaataaaaggcatgcttcggataccgatttaaagagtagcaccttacatggtccattatatcaccgtcacgcttttctttcaacctcttcttcctcaccctcccccacggccggttccgtgcctcttcaaaagttacaggttccaagacaagacgatccaaacgataagaaaatgaatatttcatcatctcccttcaattcaataacctacattccaaacactacgttatctccaatggtgcaaacgcagttaaagaacttaaccacttctaacctcaacacgaaaaagaagaataacagaggcagaccaagagctattcagagacaacccacgctgaccacttccagccatttcatcaataattccaatcctggtgctgctgcagtttcaacgacaactcccgccgctaatagcgatgaaaagaatcctaatgcaaaaaaaatcatcgagttttgtttccattgcggggagaccgagactccagaatggagaaagggaccatatggcacaagaactttgtgtaatgcctgtgggttattttataggaaagtcaccaagaaatttggctcaaaaagcagtaatttgttgttaagatatagaagatctattgatttagccaacgatcgtagaattcctgattttatcactattccaaacaggtttattcatgatatggataatgatcaaacgttggactctgagtataatacgatattgcaataatataaaatcatacattcatataatatccattacgtacgtacatcatacataacacatttttacccccttttcttttttttgttttccttttttgttttatttagccgcccgcgttttcctaacgttttcccaacattgaaaccaattcgtcatatacctcactttccataaattgtttagattcacagtgggaatgacttcagaacacttcaatttacaaccaaatttcactaaatcgttaaaactactgtgttcagaatacggtacgttaaaaacttgaaatttgttgtactttttgtattgcctcaatatactcgagatttcaaacccattctcatcatcattgtctcgatcattcttcattagttctaagcaatattctgtattgccactcatttcattctcatcatcatcgtttttcttttgatattttaaaccaaaattgtgactccacccggtaggtataaacccgacaacatcttcaatgtctttcacatagtctgtttccaactcttttaaacttttcaagtaagcttctatggtttcttgacttttcaacactcttataggtaccaaatgtacggatgattcatgtaaattgctggtgagtaagctttcgtcccacatgtcattttgattttcgttgttttgtaaaactgttagcatcattgaaaatttaacggaattcggcataacaaataattttgttttcaaaaattcacatatcttgatggctagcttctcttttccaatagtatatgttcccacaagaaataggaccctgtaacgatgagttgtcaatgttttctttctctgaaagtgaaaaaggttcctttgtgaatctccaaatgttttgtttttaccatgttttataagccgtaatgtaaaatcagccacagtctcgcacacagaatgttgtgaaggaaagttgtatcccatagtcatatatgttgtatctaaataaacttggtcaatagtttcattcgctgtctcggccaaccacttctgaattgtctcaatcattttggcgttgcttcgaaaatcccccgtgtgaagaatttgtcttataggcttatcataagaatttgccagaaactcctggaaaagcattattattgcaccggggcaatggttagcgtccaacgtaactactgaaatggtatctgttatccaaaagcgtttattcatgggtaaaatttggatttcatccattggaattttgaattttaaatttactaatattgcagtgatcttagaacagtaaagtgttttcttgatcggattctcatcaggattgttccaagattttttgagtccaatatagtgatcagaatgaaaatgagaaagaaagtactgagagatagtctcgctggccttataattgaaaccatccacaactatttcgtggccattattgaacttaattatcttgaaacttggtaaaacaagttttactcttgttggtttttttgacgtagctatatccctcttcgtttttgcaggagatgatggattagaaataaagctcctgatattctttttaggtgttcccatattgctcgggtcactgcctatgcaagtatcacagtgtgtctctctttcgtacaattctaaatgagaaaggttttctagacaaataggacattgaataacttctgtagagactttaacatttacttgctcctccaattccgttactattcgatcttcggtcctattttctattgcgctgacctcgttatcatgcaagctaactagttcttcctcgtctgtatctatggtgatttcgacctttgcagtgtcttcaaggcaaatgctattgtgatcgtcatcgttaataattactggctctgtattcttattggatgttgaacaactgaaccttgagaatgaatatgaactggaacggacaggtaggttcgatgaagttgggatgttgaattctgtcaaagttctctgccttttagaggatgtatgtgtgttcttatgaagagttttcccctcacttgtactgccagcggtgctacttcgtttccgctttacttcagatcttcttatttgcactatagatttccttgacataatcaaccgaccacccaaatcagtcactagtgcgtatgctgcttaacatgagttttgacgcaggtatttgattatgtttatattgctatttactactactactttttcagtccgtttccatgacaaaatctaaaaagccatcgcactaatttataaagataataagagggaagcttaaggtgtagataaaagaatacatgggactactaagtattatcaggaaacagaagctcagggacaaagaaattcgctgtctgattctaggactagacaattcggggaagtcaacgatagtaaacaaactattgcccaaggatgagcaaaataacgatggtataatgcctactgtgggttttcaaatacatagtctgatgataaaagatgtgacaatatctctatgggacattggggggcaacgcacattaaggccattttgggataactattttgataagacacaagcgatgatatggtgtatagatgtgagcctttcaatgcggtttgacgaaaccttgcaagaactaaaagaattaatcaatagagacgaaaatcgaataggatatgagtgtgctgttatcgttgtgttgaacaagattgatttagtggaggacaagtccgagcttcatcggaggtgtttactggtagagagcgagttgaagtgtctgttcaagccggacatccgaatagagctcgtcaaatgtagtggcattaccggagaaggtattgatgacctgcgtgaccgtctggtggaatcctgccattttacccaataatcgtctaagatgtgagcaccatataaaaactttaaataatgtcagtatttatagcgtgatagttcattacccgccgaccgtgcgcattcgtggcttctgctcactccggataataatactaccaaggggttctgtaaggcttgcgggttacaaagcacgggtccattgaagatcttacacaagaaggagtggtaggaagaccagctgattatttccaatcggtcgttgccattgtcttatttccttttctttctggcgcattgcattttaacacctttttttccagaatagccaaccaccgacgtctgattcacacattactgggcaagatcttgacatagcattacattacaacacggcaacactaatcacgcaacgctagaactcgcgcaggatgaatattcaaagcaataattctccgaatctcagtaataacatagtgtcaaaacaggtttactacgcccatcctccacctacgatagacccgaatgatccggtgcagatatctttccctaccaccgaagtagttgggcatggttcgtttggtgtggtatttgccactattattcaagaaactaatgaaaaagttgctattaagaaagtcctgcaagataaacgattcaagaacagagagctggaaataatgaaaatgctgagtcacataaatataatagatctgaagtactttttctatgaaagggactcccaagatgagatttatttaaatttgatactagaatacatgccacaatctttgtaccagaggttacgtcatttcgtccatcaacgtacgccgatgtcaagattggaaataaagtactacatgtttcaattgttcaagtcattgaattacctccatcatttcgcgaacgtctgtcatagagacattaagcctcaaaatttattagtagatcctgagacctggtccttaaaactgtgcgatttcggcagtgcaaagcaattgaaacctactgaacctaacgtttcctatatttgttcacggtactatagagcaccagagctaatcttcggcgcaacaaattataccaaccaaatcgacatatggtcctctggctgcgtaatggcggaactgctattgggccaaccaatgttccctggagaaagtggtattgatcaactagtggaaatcattaaaatcttaggtactccatcaaagcaagaaatttgctctatgaatcccaattatatggagcataagttcccgcaaattaaaccaataccattgtcacgtgttttcaagaaagaagatgatcaaactgtggaatttttagctgacgttttgaaatatgatccactagaaagatttaacgctctacaatgcctgtgtagtccatattttgatgaactaaaacttgatgacggtaaaataaatcaaataacaactgatttaaaattgctagggttcgatgaaaatgtcgaattgggccatctatctcccgatgaactatcatctgtaaaaaaaaagctatatccgaagtctaagtaatgatagcaccggagggagcccaggcaagaataatgggagaaggaaggaacatatatacgtatgtctttttttagtaccattattactgttattattatgagtattgtttttgtattaccatcatattcttatcattattagtagtaacagtattatgttatcatcactgttataatgaatacaaattatgaaaaaaataaggaaaatccaaaataaattgtaacttttttatgccatttcacttcgaattatgtataaaagccgtattctttgccagtacgaaactattttaatgacactttcactttaaccgggtaacaacttccttaaatgggtcgacaaggtttttagagtataaaggggcaagtgaaggttcatcatcgagctgatgtagtgggtgttttagtaaacgaagaagcaccttagaaccaaataatctagctagtataaaccgaacccagagtagcaaacaaaccatgggtaatgttccaggaaaaatagaccaggaagatagttttaatgatgtcaggccagattcctcatataatactacatcatcgaattctgtcatcaaacaatatgatgaagaagcctcttcaagggtgagaacgagacgcacgacgtctttggtcaataatattttaaatgggaataatgctcgtacaaaaactggttctcatctatccagcactagtagaagaaagacgtcacgggaaaaagagcttgctaaagaggcacatgctaaacaattggttgtgaggtgtagcgaaaccgtagatggggggtttttggccccatttggctgttattcttttgaaaagttggactatgatgctactgtcgttaaaaatttaataatcaaaagaaagttagcgccattttacactcctttgcaggattttgatgaaagttggactagagatgaattgataaaaattgttgacggattgcccttgcatgacacgttcgatgaaaatttggaagaattcgaagacgtaccgataggcaatttaaggaagtcaacatttaatgaattaatagacaaatctttatccaagaaggaacagagaagaatgcacgcaaagatttttagagcaagattgtataagaaaagaattttatggcaagaaaatgaaaatgagacgtttttggagaggaaattggaaatgaaaagaattggcagcaagtccagcaatgttgaagataataccagtagccagccaaggaaaaattatcatttaccaagtgacgatttgaagtatactctttacaaaaatgggtcggaatgccctatttgttttttatactttccagggcctttcaactattccaaatgttgtcaacagcctatttgtaccgagtgttttgtacagattaagagagctgaccctcacttccctcatgacgaagtagacccaactgaaccacaaactaatgacagtgaaaaggacccaaatcttcttacctctgagccagcaaattgcccctactgtgcaactgctagttttagcatcacttatcaaccacccacaaatcgtgaaactggtatagggggtatgccagccgactcatacgtgtataaggacgccgccatatcaggagctgatggcggtcagccaaacatatcagccattacttcggataccattcgtcctgattgggagattaaattgaacaaagaaagggcaaggttgatgaggagatccgcgaatgccaccgctatacatataagtaataggttgatcgatccaagccatagcacaaggagaaatacaagtcacagtataacccctattcatgatgaaagtacgtcagcttcaagatctcctgaaccgacaataaacgaacttgaagatcaaatggttagagaggctattaggttaagccttgaagatcaggacaaccgaaaaaaatcaaagaatagaaacacctctttgagaccatagcattacagtttgacattttttacaatattaaaaaaatcctttttcaaacgttccagaagtgcactatttttcttttgttccatctatatctaacggagcgtcaccaacctgaccttccttttggctttaaacaaaatgatccggaaatatcgtcacatttattgtgaagagagagaagttttacagttaattgtattgcaagctcttcccgctctagaaagtttttgttttgttcgtcctcaagaattgagagttcaagtatttcacctcaaatttgcatttgaattttagtagtaactagtataagattcccatcccgcatccgccactgagcaatgtcattctctcttttctcgcctttttatggatagaggcacatagacgatggatatcagagaagcgttcacataattaagcagttagttccaaatatgcgtacagtctttatagaggagagactgttaaaaacgaccttccgttcgaccactcaaactgtagtaggagttcatttctctatttatatgcttgcaatgttcgcagaaaaagcaccatctacctcacctccagcttagccaatttttggttggtgaaccgttccagaaatttttcagttttgggcgataccatcaatgtgtcattacagaatattcttgttggcattttttcaggtctaaagaaatttcgatttgaggtaattgctagtgctgaaaggaagaaacacagaaatctgactgaacaatgactttttggcgtgttcgaagaaatcaaatgcattatatataaacgtacgcataggtatatattcaaactcacatatataaaatcttcttttctcttctcacttgtgtcagtgcgtgacatcagtatgcgctttggatgtttatcttatctgagcgtcacaattcagtgataacagaatattttgttatgagtgatggcttcccattatacagtgtacataaaattataccagatataaagacattaaaaaagatgaaacatatttatcagattcatttaatttatttcttcttttcagcttcagcttcagccttctctctagccctcttttctctgatacctctgaatttcttttcggatctggctaatctcaaggttctgaaagcagattcaccattgtcttgaacagctctagcttcaacatcggtagctggttgagcaattgggaaagtggcagcagcagacaaaacttgttcagcttctggagccttaccgtctcttgggaaaacgataatcttggattggtactcctttaatctttgaacgttagcgtcaaagatttcttggtttctgttttgacgtctgtggtcaacagcaataccaatggttctggcgtaagcagcagtcaaaccagcggccttaacttcagccaaggtgaaacctctaccagctctaacctttctgttgtacttaacagttggagctctgacaacaggtctcaacaaatccaatggtcttggagcaatcttggcggctctggcagctctagcattacgtctagaaacctttttaccagcttggtcaaagtgaaccttgacacgttcttgccagtgctttctgaagtggttcttcaaaattggtaaattcttggagatagctataatcataaaaaaatcagttagtaaatttgcttcctttgagtaaacctttatttctagtttctgataaacgaatctcagggtaataaatcatttaacctcattattaatgcacaatttacattgcctcgccatgctgattcctctaaatatctcaaggcatccttttagtgcaacccgcctatttataaactggtcaaagtgccaattatctcaaagaatgattcttttgatcttgatttttgcaacgtttcaaagacagcgggatctaattattccacggttcctactgttaatttacagtgttatccaatgcttgtttctacacagctagtttaggcattagttcagtcgttctgtgttcgtttcaatcatagctcttactgcttcagttcaacatacccattgttacttgattcctgctttacttttccgaaattattttctattaatgttacattatgttttaacttcaagtacctctaattacatagtatgtaagaaagtaacttcccaatggaggatggtgagcaccggctccgagtaggttagtaatgtgtccttgcaatgccgcgtcagcctgaggagagcgtaccaagaagtcgaatgaccccactagagattcccctagcgaggccagtggatgagatggaagcctacgcaaggcaaaagattacactcgcgaacgtgcgtccgggatgatacagtattttttttaaaaactataaatgtatgggtgcgtaatgtacagattttatggcactgaaaatcttttcaagataatctcaccgtattacttaaacatcagtacatattggcacccatacattataaaatcatctcggaaatggaaaatgctacggccgtatataaaaattgttggcggcctggtaagaaaagtaattgacgcttgattttccttgactcccgtccagtttagcacagcggacgattggcagtttgctggaattccaagagttaccgcttagcgcaaactatcgtgaactcgctgcaacaactgagagggcaaggatatacataaaaatagcctacaaattctgaactctgtaaaggaagcctcataaataaaggtagatagtaaagtatacaagagaagaatcccaagatgtcagctgtcccaagtgttcaagtatgttttcagttctgcagaatgatgtttgatagtatcgataatggagtgagatcaagagaaaaaaaatgaatatgtcagccaaccaagttctgagtaggcagtaaatgagtacgcatagtgtatttatccaaaggaaagaattgttatttttacaagccgaattgagatccaattaggcaatgttttggggagagtattttgacaagattggttaaactactacggtcagttccgtaaccagtacgattgtacacataaggaaacaactgtaaggataaacaataagggcttccaatgccattgtaagatatcatattcctaaacaaaaatgtacagcgaatataaagccaacgtcagtgtcttcctggaaggttgcgcaactaaagaagttgaaattaaaatggcaagcactacattttcatccattttcactcatcagatgtccaagattttcgaaaaataaatattctcatttttctctcaatgaaataattgttactaacattgaaattgcctcgtaactaattgcattacttctttagacttttggtaagaagaaatcagctactgctgttgcccatgtcaaggccggtaagggtttgatcaaggttaatggttctccaatcactttggttgaaccagaaatcttaagattcaaggtttacgaaccattattgttagttggtttggacaaattctccaacatcgatattagagttagagttactggtggtggtcatgtttcccaagtttacgccatcagacaagctattgctaaaggtttagttgcttaccatcaaaaatatgtcgatgaacaatccaagaacgaattgaagaaggctttcacttcttacgacagaaccttgttgattgctgattctagaagaccagaaccaaagaaattcggtggtaagggtgctcgttccagattccaaaaatcttaccgttaagaaattgtggggattatttttcgctcttttcattttcttataattgtataccatcaataaacacaacagcctttaatttacgtaaaattatatcatggtttctatataaattacgctattacgcaattaatacgattgcctagcggtggaatgcgggccgttattcatgagacccatacatctcatagaaagcttgacacacgtcaaaattggccataaacgggtaaatgtcaacaaactaaatttcttgacgcgaaatcgagttgtttatgatgctaataatatgtagacaataatatcgtgtactgtgtttaaataaaatttatagggaagaaggagttcaaaacggtatccggggctagttgtggtattttcaagtgtgctaacgctattaaaagattgtttggactgtccgtatttgctttatttttaaggacaaatttaaaagtcatacagcaatggaagaaaataaacttagtggaaataaaccgattcaacttgctacctggtcgaaccagatggggtcaccagaaaacaatggaaataatgcaaataatggtagtgatgtacagaatgttattcagaaagctttaggcttgattcgacagttgaacaataatgggctaatgagtccgatggaagaagagcattcgcaaccttcatcttcacaagagacacttagtgtcgatagagagattgatgaacagggccgtttgcgtcttcttatgcaagcaaaagatgataatacgcggaaggaagtaggcacatattctagtccgatggattctgcgtacgccagggaaaatatgttaaacgttttgcaatcattagttacgcatctgaaccaagctgtcagccaaatacaacaattaaaattcaagaacatgattcttacttcaaatgaaaataatattcagtcgagacatgaagtggaagataatctccagaaacagcaatttgaaaggatgaagtgtcagtttctattggaacgtcaaagtttgaaggatcaattgcgaaagcgagagaataaaattgttaaatataagcagaaaattattgaaaagaacaagaaattaaacaatctagcaaaagtacttaatcaacatgcaatatctgatacctctcaaatagatagtttcagtagctcggtaaagaaaacgccttcgtcgactacaacgccccaagaaatgaagtcggacatgttgaacaccttgggaatattggccacacatgtcttgaaagatgaaattgacgatgattctggaaatcaaacgattctgcaactggctgcagggagtataagcaacgattgtaacactacggagttggaaattacgtgcagtcctgaaatgggaaggactattacacacaatcgaccaaatactaaagatgagtcaattcaggattcacatgggaataggaccctccaattgcccaaaatgaaaagtttcagtaccatagacggaagcattaaggatattaagtgatcaaagatactagataatgtttgttcttgacggcaagaaatacacaatgtcaacacccgcgctttctcttcgattcattagttgatatcattaacattatattatacatactttatttctcttggaaattaaatatttgatgatggtttatctaaatattgtctcactcattttcccttttttttaagatagaatatcagtttgaggcaacaaatgataaattatgattatgtatataaaacaattttaattttattagcataaaaaagggacgaggcctctgctaaaatatcgataaaaaaagaaataatatgaaagacaaaacaaactaacgggaaaaaataaaataaaaaacaaaactgatcatcatttaaaaatgttattctcttgtatctatttctactagatagatgaatctctacccaaaaaataaactttagcccaatccatagcaacaagaactctgtttctaaaggatagacacattgccaaataagcagatttccagaataggaaggtgaatgagccggctaacctatatttggcttcaccaacggcaagatcagcaatggctttatctgaaccaatataagccagagcacccttatggttgtacttgaagtcttcaatttgcgattgcgttttcactatttggttctttaatctagcgacttctgaatcgtctttggcatgggtcattttccagttcaattgatcgattttataagctttcttgaaatactgagccaagtattcaccttcttggtgggcaacttgagcggtagggaacaagccagggtggaaggtacaatcgccgatagcaaaaatagatcccttagcacccaaaagttgaagtttgttatctatcaacaaaccacgtcttgagtcctgttcctctaatttagtcattaggttcttagacacttctcttggcgcattacctgtagcccaaactaatacaccatacggtatattttcaatgtcaccatcgccagttttggcagttatagtggtagcgtcaactttcttaaccattgttttcaatcttaaatcgattttttcctctttgaataaatcttgagcatagtcaacgagatacttgtcaaacatgttcaaaatgtttggcaaagcttccaccaaagtgactttaatttctttactcaattcgggcatccattttctcaagtcctggtcaacataatctctcaattcagcggcaaattcgacaccggtgggaccaccaccaacgacaacaaagctcaacaatcttgctctctcaggatcttttggagatagggaggcagctttctcaatactggacataatttttaatctgatctcttgagcgtcggatatttccttcaaaaaagaagaatattcataaactcccggagtaccaaaagtgtttggttgagcacccacaccgacaaccagatagtcgtatttcaagtccaagtcgtaatcgttattcttagcggaagatttgaccttaattgttttgttttcaggatcaacgtcgtacgcttcagcttcatagtaatggacttcaccgtgcgatcttctagcaatagtcctgacaggttcaacaatagatttcaattcgatggtaccaactggggtagatggcaatagcggagtaaaaagaaaataatttcttggagaaacaacaacaacattatacaacgtggtgtccaaatttttcaaaagcgacacagaaccccaaccggagcccagaattaccaaagtcttcctctttgaaccgtttggaaaagtgtccgattgaggaacttgggtagaagggttagcttctcggtaaagcgagtatgaaacgtaagccgtacccgcgagggcagaatacaataaagccttcaaagtaaatttcccagttctcttgaaaaaggactgcttcgcaacaacgccagtagtgggcgccactttttgcaaaatgactttcttgtcctctagcaaatttcttgctgcatggaacgatctatttttggcatatttcacaagccccgacttgctctgtaggctaaacctggaggaattagcccacactgttttcattaatgattgtctaatcattattattggttaattttttatttgctctaataagtcaatattatgatgctatatgaagaatattagtgtgaaaatttttttcctttttctctctttaattggtttaccagaatatataataaaagatagtagctgcgtataaatttagtctaaatactaaacatgcaaaagaaataatgaagataaaaacaatcgacacacttatagttctagccccaacagcacaaaagcggaaaaaatcaaaatcaagaacaggccaatgagcgttgtcttatataacacaacctcttttatatatacacccaagaaggagaatgaaaatagaaacaccacacgcttcgagacaacggaaagaaagcataaggaatggcccatgtgtgccaaaactcttctcattgccgagccatgtattaccatcccgatggtgatggttgtgaatgcaaataccgctgaggccagagtaatgccatagcgaggaccagggcatctcgagcatcgtggagaagatccctgtcgctttctttttttacctcaaaaccaaatgcgatcgacgggatcgcggcaactttttatcggtcggaatggttgagctagggcgttttcgtaaggggcggggtagagttagaattgtagttttttttccgtagtgccgtgcccccattaccgaatctcggcattgggtaccagagggttagtgcgatagttctttagcaagatgttaaacccgcctatgcccgggaactgcatacagggaagatctcaccggaagattacctcgaaggggaggggtatgtgttttttcccctcgtggttaaagtgactctctattaacgtaatgaaaagtctaaatattataatgacttgcacttcgtatcaagatatacgagagatcataataaacgaaataatatccacagtttgggtttcatattcttatatatatatacgtacgtatatgcatatatgtatgtttactatacatcaacatcagcatcaaaattaacattaattagcttcttgcatgtgctctttagcttcggcggccttctccacgtcgtatttgaaatcaaagtaagatttttcgaaatggtgtagacgtatgaacccatcttcaccaccggaggcataacttgtgccctgtgggctaatggcaactgtgttcaagggaccaaaatggccttgtactctgccgatttcttcttcgaagatcttgtggtagaacctagcttcaaacttaccttcgttggcactggtggtggtgacatccttggcctcttgaccaccaccaagaataatgaattccttcaatggggtgattacggcggtgtttagaggacagtctgtttcgtatttcttaagaacttgtagagtcgatacatcgaccaagaacgagttagtatctctggatgatgtaataaagtatgttaaatcaggagaaaattgcatgtcactgatggacttttcgtgcaaatcgatggaatccacgtattcgtagttgttggacacatcgtatttgctgatcttaccgtctttatggcctgcaatgatgtatttgcccttagtcgaccatccagccacggtggcagcgtctaaaccttcatgagtgataattttatggattggctcttcggagacctttgttaattcgtgagtggcggaatctctttcaatttcgtatatgttaatggaacctggatttttcatgacgttgtccaagatagctagaaagtagttaccgcatggggaaaattcaactcttttaacggggacaggcgatttccatgtagcaacacattgcccgtttgacacatcccataatttgatactgtaatcagcacttcctgtaacacagtacttggtgaaacagtcgacgtcgatagaccaaatggtaccggtgtgaccatccaaagtacctaatctttcaccgttcaacgaataccaaacactggccgagctatctttcgaacatgaaaatagtaaatcaccttctttgttgtacttcacttgagtcaatggacgttcatgacctgttaatttgatagccttcatattccttgtctgtgctatttctttttgtcttctctcctggccagttatctaacgaccttaagatatacctcgcctcttgttcatcagtaactcttctgcaaatttttctgttcagttacgactattcgaaatttttcagaggccggaaaaaatttcacaaaaaaaaaaatatgcgaaactgaaggtggcacgcggggtaactgatatatttcatacgaacagcggctatacagaaaccccactatatttacaaagaaatatgctctggaatctacctacaagtgcgtgttaatgagcttgagtctataaccatagttgtgatgaaagagtacttcttgcgcgaaaattcaaaggataggcaacacaacagagacccgctgaataaggtttctcatctcaatcaattacaccgtagtgtagggttttatcagctcaagcgagtttttcaacccttccacagtcttctctttattaataaatatgttggagatatctcctgtatgggtaatatgtatatatgtaaaaaaaaaaagaaaaacaaaagaaccaagatcgggctacgatggataaaaaaaaaagaaaatctgactactcacaaaacttgtattcatctgtactttcaagacgattaaaataaaaagtgacatctgaaaaacatccaatactccgatggcagccaggaatcgtagaaagaataacaagaaaaagtcccttttggtaacgagtgccgctcaagaaaagaatgcgacgtatgtgctcgttgcagaggaattacataaaaacacaatcgatctaaacatgggtactgaaacacctttaacggaaaaccacgagaatcctataccagcgaaagaattcaagcaccagcaaaaattagagccaatagacgaacatgatgatggcgaagacgaattatcgataaaatttaagtccatgacaaaaagctcggggcctattactgaggctgaagttcaaaagctgctcctaagctatgccttcacaagtgctgcaatacaggaggacgaaaacgagaaagaatcgcgtcactatcctattaaaccgccttcgccatcagcttcttctttgtccgcctattttcaatccttcgttgaaaaatgcaaacaggttttctacaacttcagtctgcaaacagtagaaaaattaaatgctctacaaaatagcttgtacgaagtattttggattatttttatttatttaaactactggttccccaatgtgggtgactatgtgaggtatgtctgtcgtagcttctcgcgccataacgaaattgcccaattactaacacgtatttttacttacaatatcaaccacctccactaatgaacagacacagtatagaaaaaaaatcagatctgcatttaaaaggctgtcttttccaatgatcctcgaccttagcgcggctaatcaattctactcacttttttgttcgcttttttttttttgacccgttgaaccaagcgggttaattattttttaaggataaaggctaccacaatcatgagagagacaccatgtacttgcaggattctgatattttttctatgcttgtttgctgacatgcagattcggagctggttttgatatttcataatcacctatttttgaagcaatacttttggacaacaagatagcattattattaggatttccctatcaaagcgtcatttccgtgcacttcgtgaaaaatccagtcagaaagttcagcaagcactcaagaatatctacttttgtttccaagaaaagccttacctgacagcgttcaaagtttcctttgccattggacttgctattccgtgttccctactttttttgataatggtttctaccgctacatttttcttttttgtttacttaacccttttcgtagtgataggtttcttctcctcattattcataatacccttattgggcatttcctttgtgtttgccattggcgtggtatcatttggcttctgcagcaacatgagtttcaaaatggcccaactcatttatgtccgagctgacgccttcttgaaaaaagtcctcgacaaaatggccctacaaacacagccggcacaactacaggaaccacaggagccactttccacattaaggccagtatctaatccaactattccaagcccattaagacaaacggcgcgcccttctaaattcgtcaccgaagaagatgttattttcgaacctgttagtgctcaaagcgccattgcccgttcattagagactactgctaataaagcgggtaataagttccagctctcttaacctcggcaataaaaaaacatttttcgcaagtttagcaggtcaataataataatatccttataaattacactcagttttttattacatatgggcctttaatatgtacatacgcatatatcttagctttaccgatcttctaatattgcggcctataacgcatagaccataaaagaaacggagcagatgcaattcttcaaaacacttgcgaccttggtgtcgtgcatatcgttcgtcctcgcttacgtggcacaagatgttcatgtatcattcccctccaccgcaggaaagtctagggtaatgatcggtaaagttgaacccacaataggaatcgatgaaactgttccgactacaatcacagttgaagaccctaacgaggtgattcaagtaaatttcgccattgagtctaccaacaaacccttccagaacaccttattgataggcttacctaataagaacctagaaatggcttttgaacccgaaattaaggacaatggcaagttgtccatgtataaatacaggatagatttagccaagctggatgctgctttgttgcaagaggcttccagatcaccggaactaataaaggccactttgattctagcgtcatctaccgccaaaccaaaggaaaacttgttcagggaaattctgcaactcaacctgaacttcgatgtagatcactcagattcatctttagttggcaaattcggcattaagccagaaatccatcatatatttcatgccgagccaaagagagttgccaaaccaattgctgtgatttttgttttaattatcttcattaccattttatctttaatagtcacctggttgaattcttgtgccgccgcattcgataacatcccgaccggtgtcactgctgtatatttcctaggattcatcgccacgattgttgggtttgaagttatcttcgctaggtactacttgggtacaagtatttttgaaactctattttcctctttgtacttgggcgctccaggcttactgacatctaccaagttcctgagatcttttggtcaaacaatctagattgttctgaagatcaaaataatatatatatatatatatatatatatgtttatacactttacttacgtacaaaaatatagatttcgaaacgaatcagttgctcttagcctgcacatctagaaatgtattattgatccatttgaaaccccaaatattgcgtatcgaaccgtcccagaagggcttgtcaaaattgttagcagctacaatcttgcccatgatcagccccatgggtaatgcattgtatgttcttgaatctaatgaatgtgacaaattatctccggttacccaaacatgaccttcagggactttaatataggtaccaaacctctcctcatcaacaagcacatcgccgacataattaactatcgtactgggatccacgagcacgagatcaccaggcatacccgtaacccttttgcaaatcctatgattagggtcagtaggtttcagtgctactatgcagtcacccatttttatgcctctaccattttggaaatttttcaagacatgcacataatcattggtcgctgacagtgttggcaacattgattctcccctcgtctcagtaaattcgtatgcatacatatgtattatatgcaagaagcataatgacctaattgcataagaaaaggtttttgaccagatgggaagtgtaccaaccgtcatccctggtattgtacactgttggatgattcactgtcttattggtccgtttttgtttgcaataatatactggagtatttttattgaaggaatgctttttccccagaaatacttagattgtcagagtgttataaatttgctgtgcggttcaaaccaacagaagagaatattcaaagaaaagctcagaatatatcaagtccatattcaagagaagataggttgcagtgaatttaacaccctactcttaatttatcaactgggctcacgacacaagatcaacagacaaataaacgacctactgtgtaatttatgcagtaaaaatcacatgatttatgctattatatgcagaaatcattatttactcttcttttcctttgtactgtcggcgacgattttcttaagaggatccctgctgtaaaatcctttcagtgccctctaaagttgaggggggcaaaaatactgtcctccttttaatacataaaaaaatgactggcctttatttgaatggagtaaaactaaaatatttgggcgtttctattatcgaacaacaaaaagtaatactttaaaactatgtcagacgagattgtaaccaacaaatctgttacttatgttaacaatactactccagtcacaattacatcatcggagctggacttgagatcatgttatcaagatgacgaagttgttatagaagtccatgctgctgctttgaatccaattgattttattactcaccagctttgtaactcctacatatttggcaagtatccaaagacttattctagagattacagtggtgtcatcattaaagcgggaaaggatgtcgacaatcgctggaaggttggcgacaaagtgaatggtatgtacagtcatatttatggtgaacgtggtactttaacacactacttgatactcaaccctgccaaagatatacccatcacacatatggtggaggttccaaaggacgaaaatgacccatatgacgactttgtatatgctgctgcctggcccctaacatttggtacagccttttctacattatacgatttcaagaaagattggacttctgattcaaaagttctggttattggcgcttcaacctctgtgtcatatgcttttgtccatattgcaaaaaactacttcaacatcggcactgttgttggcatttgtagcaagaattccattgaacgcaataagaaattaggatatgactacttggttccctatgacgaaggatccatcgttgagaatgttaagaaattaaagcaaatcgtgttggaaaacgacaaatttgacatgatttttgattcagtgggtaaccatgatttcttccctgtcattgatcaatttctaaaacctaaggcgaaaaattccttttacgttacaattgcaggaaataacaaggccaattataagaatatcagttggagagatttcgtatcattgagttctattttaaaggctataaacccattcaaaaaatacaactggcgctttggacacccttatccccccaacaacttcattgaagttggcaacgaaatgatcaagaagggcacttataagccgcctattgattccgtctacgagtttgatcaatataaagaagctattgacagactgatgtccaacagagctaagggtaaagtagttgttaagatgaaatgagggcaatattttccacataaacttgttagtatatttagttaaactctataattataattgttattagtttttgtattatttgatgggcattacccgaccgacttgtcatgaagtgaaagaaaagctcatcacaatatttttaaacagaatttaagatgcattagctggcaaactacgtttcaaatatacagctcagctagcccaaattctctctgcactctcaataacatagctttttaaaatggcagaccttcaaaaacaagagaatagtagcaggttcaccaatgtttctgttatcgcgcccgaatcacagggacaacatgaacaacaaaaacagcaggagcagcaggagcagcaaaagcagccaacgggactgttaaaaggtttaaacgggtttccgagtgcaccacaaccgctgttcatggaagatccgccttctactgtctcgggagaactgaatgataatccagcgtggttcaataatccaaggaaaagagccattccaaattcaataataaagagatcaaatggccaatctttaagccccgtacgttctgatagtgcagatgtacctgcgttttccaattccaatggattcaacaatgtcacttttggctctaaaaaagatccacgcatccttaaaaacgtatctccaaatgataataacagtgccaacaacaatgctcatagttcagatttaggtacggtagtttttgattctaatgaggcaccgcccaagacctccttggcagattggcaaaaagaagatggtatattttcaagtaagactgacaatattgaagatcctaatttgtcttccaacataacctttgatggaaagcctacagccacaccttcgcctttccgtccactagaaaagacttccagaatacttaatttcttcgacaaaaacacgaaaacaacgccgaatactgcgtcaagtgaagctagtgcagggagtaaggaaggggcctcgacgaattgggacgatcatgccattattatctttggatatccagaaacgattgcgaattctattatattccattttgctaatttcggtgaaattttagaggattttagagtgataaaagattttaaaaagttgaattcgaaaaacaagtcaaaaagtccgtcattgactgctcaaaaatatcccatatatacaggagatggatgggtcaagttgacttacaaatccgaactttccaaatctcgtgctttacaagaaaatgggattataatgaatggaacattaattggctgtgtttcgtatagtccggctgctctcaaacaattagcttccttgaagaaatcggaggaaattataaacaataaaacaagttcacaaactagtttaagctcaaaagacctcagcaattatagaaaaacagaaggaatttttgagaaagctaaggcaaaagcagttacttcaaaagtgcgcaatgcagaattcaaggtttccaagaattctacttccttcaaaaatccacgcaggcttgaaataaaggatggtcgttcattatttttgagaaacagagggaagatccacagtggtgtcctgagctcgatcgagtctgacttgaagaaaagggaacaagcgagcaagagtaagaaaagttggttaaatagattgaataattggttatttggatggaatgatttgtaatgaaaaaccttacccccaaatgtagtgctttggtgcgattccagcatcctgtgatgttcacctacttcaaggttatataattttgtgtgtagaattgtaaaaaggatggatagacagttcttgagataaagcacagttattttggtatcacatcgtcggagtatttttcaattctgattttttgactggacccaacaaacaactccaattcatccaattgtccttccgtaggtaaacaactggaaataggtacacttctttctatcatcaatacaacaatgttaatacgagagacttccagatcaggtataacgatgcccccagatggacatgtcctatactcttgacattcataaacacagagagctgattcaggctcgaaaatattacatcgtatccttaatcgtgctgatgattccacgggtactacacgtataaaaagtttgttcgtagaatactttttggttggcaaagtcatctgaattttaagtttgtctgaagtttccttccaatggaacctgttgcgacaatgatatggataagtaccgtatatcaagttaacactccgtaaagttattccagatattaacctccatgaagaggataaccgtatcgaggcaagcaattcaaattccattgaggctggagggccgtaagttgagcaaacaatcatatatttgacattagttaagatgggcacgtcttgtttaaggccctgcccgggctgatagtggttatcaaacattattggctttatcaattcatagtcattaaagtaatatacttgaatgttaattaaatcatgtgagctagttgagatacatgcggcgtccataagtacttgataatcttgttcagagtgaacttccaactcaaaagtcggattttgaaaaaaattacaagtatcaaatgaggcttttccctctatttcataaggaaaagagaaaaggactttggcaaaaagactttttgtatctttcaatctttgaaaacatatttccttcacaactgagaaagagtgaatactgaaattgttgtttgttgttgaataacaatacaataacctctcagtctcagcatctaatctcaactttaccagctggagtccaatgcgattgccaccgcattctactggaggttcaattggacatattatgcattcgggagcctcattcaaaaaggaaactgaccgattttcttggctgccttcattttgcaaatgggattctagcaataaccataccgtctctgtcactttagaattgtttaccaggtgaaataaaggtttatctgcaacgatggaaaatttattgtagcgtgaagtatcgtaccgaaaatgaagtacctgagaacgtttgaataatttttcttggttccaattaagataaagttgtttgaaattttttaaatactgttcatagctgatttcaacatttagtgccgagttcctcggatctcgcaattttactagcctagaatcatatgtgatatcaattatagagtaatcatggttctcaactaggggctttatcatgtcattggaacgattcccggtgccagcgcccatcagacataaattagatttgtgaaacttccataatttttcgaaaggatagctgtttacttgtgttatctctggtaagaagccacttaagcggtaagtatctatactaatatttgagccatccgtggaatatgttcctttagaaacaagtagtaatgcaagctcaccaattttgtccgaaatatcgttactctttaaagaaagttgtttgccatccactgaggttgggatctgcgaaatatctactgtcactagccttttgttgcttccgttaaaacttaaattgacgtgatatttagttgatgatatttgtttaattagagggagattcaagttcttagacctaagattaattagagaagcaactaatgagcaatctggcacatctcggcattgttctattccgcctgaatagtcttcttcattctgtaacttggctctccctggataacgcctttgtagttcttcagtaccaggtgcgcaatattcggttttattccaagaaaccggtgaggcttctgagataggtatagggggataaaaccttgaatcaatagttgaagtaagccataaaaatcttaattgtttatctactttcgacacattttctttcaaaactaaaacggcctgaataaaagtggaatcatcgcttttcattgccaagccaaccaatctattaattatactgcttgagtcaccttctgcattacaatatattgactttatcgcggcattgaactcatgccactcattcatttttgataccacaaggttcttgtcttccactgaaatgatcgagtaaccgtttaataagttgtctagagttgattattgtggtccgtttatgccgactaaaagaacatttaactgtagtatcataaaatcaaaaagggataaatatccgcaagaatacaagaaagaagaagtatatatgttttctttaaaatttcagagcataacttgagccatgaaaaaccacttctcctcaagtttatgttgttcctctatttcctacaaaaatatatttacatttggtcgatatcgaagatctggagataaggtaaataaatcctgcgcggttcaaagatactcgataaacaacaaccaatgtttcacagagtgccatggtaaagaaacaccaaaatagtaagatgggtagtacaaatcactttggacatctcaaaagttttgtgggaggtaacgtggttgcccttggtgctggaacaccttatcttttctcattttatgctcctcagctactgagcaagtgccacatacctgtttctgcctcaagtaagctatccttctctttaacaataggaagctcactgatgggaattttagcaggaatagttgtcgatcgaagtcctaaactgtcctgtctaattggttcaatgtgtgttttcatcgcgtatttgattttgaatttatgctataagcacgaatggtctagtacttttctcatatcgttaagtttggtactcattggatatggttctgtctcaggtttttacgcttctgtgaaatgtgcaaatacaaattttcctcaacacaggggtacagctggggcatttcctgtgtccctatacggtttatcgggcatggtgttctcatatctttgctcaaagctttttggtgagaacatcgagcatgtcttcattttcttgatggttgcgtgtggtagcatgattttagtaggctatttctcattagatatattctctaatgcagaaggagatgatgctagcattaaggaatgggagcttcaaaaaagcagggaaacagacgataatatagtaccgttatatgagaacagtaatgactatataggttcacctgtgcgttcatcatcccctgctacctatgaaacttatgcattgtcagacaattttcaggaaacgtcagaattttttgcacttgaggatagacagttatcaaatcgaccattgttatcaccttcttccccacacacaaagtatgatttcgaggatgagaataccagcaaaaatacagtgggcgagaatagcgcacagaaaagtatgagattacatgtattccaaagcttaaaatcttcaacatttattggttactacatagtattgggtatactacaaggcgtgggtttaatgtacatatattctgtggggtttatggtacaagcccaggtttctactccacccttaaatcaattaccaattaatgcagaaaaaattcaatcattacaagtaactctcctgtctcttctttcattttgcggcagattatcatctgggcctatatcagattttttggtcaagaaattcaaagctcaaagactatggaatattgtcatagcatcgcttttggtatttcttgcatcaaataaaatatcccatgacttcagcagcattgaagatccttctttaagagcctccaaatcattcaagaatatttcggtatgttcagcgatcttcggttattcttttggcgttctatttggtactttcccctccatagtagcagatagatttggcacaaatgggtatagtacgctgtggggtgttttaacgactggtggtgtattttcagtgagtgtttttaccgatatattaggtagagatttcaaggcaaatacaggagatgatgatgggaattgtaaaaagggagtgctttgctacagctatacttttatggttacgaaatattgtgccgcttttaatcttttgttcgttttggggataattggatatacgtactatcgaagaagagcaactgcaaattccctgtagacggtgtcatcctgacattgctttcatattctttttcaccatcacaaatgaacattttaagaaatattactatatactagtatatattcaacattttacaacggactacccgtgaaatatttcctcagggtacttgaattcaacgtgcaagttttcagcaaactttatgtcagaatcactgaagtcctttttcctcccagcagcgtcaccgcaataatatatccaattcaacttgatgggagaaatttgttctgaaaccctgtatgcgctttccaggtcccttttaaaaaactctaccattcctgtcattggttttcgaactttttcgaatatgttaggatcattgttataactttcacctaagcttgcgaatgtgatcttactatgatttgctgcaaaagttttcggccttttaggtgctgcatatagccataacctgtgtgataacgtttctcctctctcatcgtttttgattgcctttaaaaatagcaaaattttattagtgtacttggtgcaacttttagaagttcttgggacggtgatgacaccaccttggttagaaaatatgactatgacggccgtgggatcattatcaatgatattacacaggtaatccagggtggatttcttggagttaaaattaataaactgccaatcacttgcgcttctactaaaacttatattgggggactttggtttgataattgtatggtccagatcaaaggcataaacgtttagaccatgctcgtcgtgatcaatggattgtggaaacttgggcgtgaacttaatcagaaatggcaggattgttaatttgtgggacatgggcttttcttcggttcagtttcctatgttatccatctgattttgggatggttttacagattaaaatcgatttaaagccatacgcaaaagaggggaaacgaaagaaacgcacagaattcattcacatggatgaagggaacagaaaatgagaattttatatgacagaaaagcagcatattcaggacatatatccagatatatatacatgtaagctattaacaaggagaagaaaccaaaaaaaaaaaagaaaacatcctcagatgatatcagctttacctacagtttcgtaatatttacagacgtcagagccactcaatttcctcggaacaaagattttagacactatagaaacctcattttcaaatcttgttgcatcagcaatcgaatgaggaaagttcacaactactagcttgtcaccggccttgaagttctctttgaaatatctacccaaaagcatgaccaacataccggtcggcaaattgtaagcgtacgtgtcacacccgtattttttgtagtattcatttaataaagcctcatatctatcatccctcaaggttctgtagtaatcgatgaccttgactggatcgacaaactgcagctcatttatatcatcgccttgtgatttctgcagtacctttctagtttcttcaatgctgggtgataaggaaaactttatatcgacctcaccttgtgggaagatagccacacgtcttttcaaccctttaaccacattttcgaattcttcttctgataatgttgtcttcggtttgttcttatctaaagactgtactgtcttgacaaatatcactgtaccaataatagcaacaaggaaaattttcttaaatcctggagcatctattttatctgatttgttagaccttttagttgagctatcagttgatgagtatcgtgctctcaagagcaatggtgaaaataagggtaattgcttttgaggcaacccaccgcacaccttgaaacaatgccggcagcttgctagaacgctttttctcagtggtcgcaacatgtaggtagtctatttatctgggctcgttatgtattaatcttcctatggggattcattcattttagctttaccggcagtccttacaaaccgctttttgaaattaaatcgacaaactgaggaagaagaacggaaaaacagaagaaagccaaaggcaaagaagcgaccacatacacctttttttcgatctaaactaatcgcccaaaatgtcgttggtcaaacttgcgaatacgtgtgctcatttacagaactgctcgaaagttagagttgccttaacatcgatcccatatacgaaattgcagctacagtttgcgtataacctttaccaacaagggttcttatcgtctttacagaagggatcgactatgggaccagacaaagattttgttgaagtaacaccagacaatatctctactagaaggctttgggttggactgaagtatagagataacaaacctgtcctcagcagctgcaaattaatttccaaaccaaattcaagaatacacctgccaatggaagacatgaagaaactatgctctggcgtaactattagaaacatcaaaccactacaaccaggagaactgattctagttcgagctcataataacattatggacattaatgaagccatatccaaaaagttggatggagaagtactatgcagagtaaaatgaatagaacaatcacatatgaccgtatttatacgtgtaattaaaaaatatacggaccatgtaaataataatattataaaatgcaggcaatgatgatgagtatagtactacagcaacgtccttcattcattacctttactagcagtgataaaaagttttgaaaaaatgtgctccaggggaggttcgaactctcgaccttcagattatgagactgacgctcttcctactgagctactgaagctatctgttattgaagattctagcattaaatgctttaatattcaataaaagcaacaatggagaataatttatcagcaactaaatttatagacgaagatcctacgccaaatcttagctcctttatatttaatattgaaaaacatatgaattttaggttgaatcctcaaaatgtaattgatatttctacataatagtattacgattattcttcactctgttttatatgtgtcattatgttattacattatcaatccttgcatttcagcttcgtctaacttccatgacagtttctcataccttatgtcatcgtctaacaccgtacatgataacatactggtagtgtaactactagttgatagatgatagttcattttcattccaacaattgtcgttagagatcgctacataatcaacctttgcacttcagcttccattaaatctgattaatgtttcttaatctttaagccatcttcttgcaccataaatagcaatgaaaccatttagtcttctattttccacttaaagaaccaggtttttgcatttcagccatcttaaattagacgacggtttaatttcggtgtagtatcataaaatttcggccatccttcgactcacgtataatgatggcctcagcgagaggatcagcaacaagttacatccacaataatacgcggagttatgagatattacagtaccctccccaaaaatataaggtttaccgcaagatcgtatcaggagaatgaacgggtctcttagtttttatccactattctttccactcacgccaatatactaaccaattgaaatgctcataaccagaatgaacaggccgcatgcattctttagccaactttcgatgaaaatacccactatgcaatggtaaattttcgaaacaaaaaattatacttcagtgttcccacaaaataacgatatgtttcttttcatttttcaatgaaagcatgattttttcccttccaatgccaaaatgctagtcctataaatgaaaaaaaaagctttctgctataagaacagcaaggggcatttcaacttacacataatagaaggtgagataaagaccatcgtgaatcctaatagaaactgcgggtttcttaggatcatgggtcaggcaaaaccgccaagtttaccatcaaaaagctacaaagttcaatttacccaatagaattctaacgccaaagatttgtagtgattcatatgaaattttctttatgcatccagttattactattgagtttctctcaagatacattctccaaaaaaaaagcctgttctcgcacaaacgaccttaagaaaggtttaaaacagctgtcacattacattatagtagataaaaacacgaatggcattttctaacttgcaggtgtactctctatagcatgtttaacatattttcacctctttattgcaaacactttggcgtttcatattctgtccatgtatatgcaccacaatgattttattttcttttgtatgcattttgtgacgatttgacaactgatgcatcatttcgttccatctatttcgctgttcatggcttctgtctctttctctgtcttttttagccatctcgcaactagctgggaatgttcttttttcagatccgagagtttttgttgtaaaacattattttcaatggttccactaatcaattcgtcattcaacctttccgtattcttatttttcaacgcaataacttctttcaatcttcgtatttcttgctccttacttttcagttccttttgtagtattgccagtgtattcaataaagcatcgtcatggctgacaatgttgccaccaatggcgccactattatcttgaaacaactcatttaaatgggcctccttgtcgtttcgatctgttagtctacgaattaacaaatcatccatgctatccgtttgtggattgcttctttcctcctttgctttcttcctttctgttataatgaaattgcccatggaatatgcgcccttaatacagattcgcgcaggttaataacaaaaatcaacgttaaataaaggtcaactacaaacagaataagtaaaagcgagcaagtgcagtagcaatttagcacaacatataaaacgctgttataatggatgttgtgcagcagaaacaggataaacaattgcagcatcaaacacaagagcagcagcatatacgagaggaccagcaggaagtcccaccccaacgtccacgacaacaaaacagatggaaaccctggtggaattccactgccgacgatgagccaaacacgggaagaattgcagaatatcctaatggacaaggaaggagtagtccgacaacggattttcaagatagcgtgaactcgaataatgacaataaagggatatggtctaaaatcgcttcttttgcaacatccagatatagaagtgccccaattgttgttgatgataatacccgctactctcaactaaacactgaacaaatcaacttcttggaaaatgaggctaaggatataatttcaaaaaagtcgaaatcatggtgttggtacgaagcaattccacatatatcaaattcatcaaacataattgattccatagataccccaggaataatcagtgtctctggtacaggatcagccaaatgcccattgccattaaacaaatatcctggggagggaggtaaccctgggtataatgtatttattaatgattctttaatcctaccatcagacaaccctttgaattttctgcacgtccaaccactaagaactaaggtattgaatactatcaaaaattactataacttccctaatgagcaacatctctatttaagacaaaaaaaaaccgcattactgaaggataagagaattattataatatccgtcgtgggggatttaccagaaaagtatgagcagcgctcattagaatcacaaagatcggcttattatctttctagaaaattgtcacaaaatctagcgcaagaacaacctcaaagagtcttgaccctatcgttccagtgcccactgcataatcaagatttaatacctacatataaagaatgtgtagagttactgaaccactgggctcatcttttcaaagaggtagattcaattttttttgtgggcgtttatcacagcgttcccttaactttgctattagcgaaatatatcgtgcaaaataatgaagttctagagtttgatgaaaacactacagtgagtgtattgagtttccagtcatgtttacaaggctatcgattttgggaccacagcactgactttactagcaatagttataataacttgggttccaattccagtactaacgaaaatgatagtaatgatcatgattcaaataatgatttcacaacgaagagccaacaaatcaaagaaaaacagttatttcagggtattgacaaaaagcaacaagacacattatctaaaatcaaaaattataggcggatagattctagtgaatctaaactagttcaggatgcattggattggctcttgttcaattgggatacgtttcgactgacattttttggtaagctttatgataattttatgacaatttcagaaaaacttgctatagattataatcaccctaaaatcttgagaaatttatggtgcaatgggaagtacatgggcattgatttaaagaatgctaataatttaaaccttgataccgatgatgaagcaactagtaacattaatgacgtccatgtaaggacccctaattttgaatcgagattgaagattcccaccaacagacttttcgaaataaccttatgggatattttgatgataacggagaatttaggatataaacaatttattcccataattaatttactaagtcctttttttatttcaaggtcatttaatgattacacattgcctccaaatattaggaaacagtaccagaacagcaacaaaatctggcttcaagaaatggacagtaagtggaaaatgaatggtcatcaactcaattacgaccaaagggagggtgaaagtctcggttcatcatcggaatcattattgccagagaatatttctacggtaaaggattttttgcagtttgtgcagtatcaaaacgaaaaatcttcggatttcgtaaggatatattcagacatttatgatgacgataaagtctataaatgctttctgtacaatacaatattcacgaaaaacccattaagtcgtaagcatttacgtttaaacatcgacctcgacactcctacaagcatattgaatactgtcaatcaatatgatttggtatggaaaattcatgattccttctccaaattgattcaattgaaaaatttaccgcagcgagagataccacatgcgttgaggctctccatctcattaaactgcttcttggatagtaccacgagtacttctggccctgtttttcagagggacaccgtggaagctttgagaagattaacagagatttggcgaacttaccaggattggtctccaccaacaaggggtttgaaacacctacgtgatatcctgagcgttttagccatgtatgacaaccccaaaaacttgattaatgatgttcgacgtacatagtagattcgtatatagcggaccgcgtaacatattatggtatttgtatagtgggtaacccgcagagtaggctggaaagtattcgtgaagaacataaaggaagctggcagaagttcttttcatacacctctacttccagaagccataatagcagcaacgctgtttctgcaatataacttgtggaaggtctataataggaagaacatgtctttcactgaggatcaagaaaaaatcgcgctagaaatactgtcaaaagacaagcatgagttttacgaaattttgaaggtagataggaaagccacagatagtgagatcaagaaggcatacagaaaactagcaatcaaattgcatcctgataaaaactctcatccaaaagcgggagaagctttcaaagtaattaatagggcatttgaagtactaagcaatgaggaaaagcgcagtatttatgacaggataggtagggatcctgacgatagacaaatgccatccagaggtgctgcttcagggttccgaggaagtgcaggtgggtctccaatgggtggcggatttgaagacatgtttttcaattcacgtttcggtggtcaaagagctggaccaccagaggacatattcgactttctgttcaacgcaggcggcagcccattcggcgcttcaccatttgggccttctgcttccactttttcatttggaggccccggtggtttcagagtttatactaataatcgtggtggctcaccgttcatgcgtcaacaaccccgctcaagacagcagcaacaacaagcagaagaaaatgcagtgaattcgcaattaaaaaatatgctcgttcttttcatcatctttattgttcttcctatgattaaagattacctgtttagttaaacacaatatttttactgtcatttttttattattttccaacgttagtcaaagttgtactataaaataaaactacaaggagcaagcaaaattgaaaaaacgcatttgcatactagatgacatttaggtcattccttcaggcttcctggctatgttttattttgttccacagtttaccagaaggacataatggtattagaattttaatatatcgaggaaattaaagcagacagtataatacttataaacatctttattttctgataactaatcatagcatttacgccatacatttactttttcttttgacaccgaaagtaatcaagccacttttataattagagttagtttatagatagtatttaaaatttgtgaagatttcccatgcgttgtgccttgctttctctcaaaatacatcttgttaattttctaatgtgtggatgccgaaataatattcgactcaacaaatcaagtaagtcttctaagctcgctactaatttccaataaaaggtatatatataaaaatgttctcaataatgtaattaaacaagatcacgagaattactccagatcctttagccttgcctgaataatctggttcacatcttcatcttccacattcctcgatggaagcttcagtttcttcgtcagtttagtagttatattgccgccaatactgtctttactgctttgtgttttcaaggatggtcgcttgattaacttgccactaggtaatacctcgtatcgttcagagctctttttagaagagcttccaaagaaatttttttttgaggaatggtctacattcccatttgacattgaatatatgctgctgttatgagtttttgcacttgcacgtgaattagttcttggccttgaaagaactttgtctgtgtaccttgtgaaagtactgggatctttatcccacgtccatccttgcctcatttcgctataggcccctagttccagcttctttctgatatcacttttttgttccagctcagcaaaaatatcagaatctgatggccatatcataactttgaatgttttgtaaactatatccaaagtgataggtaacagtgccaacaccaagctagtacaccagaatgtaatgtctttaccaaaatgattgtaaaagccatatgctacatcatatatttggtcagtattatttaaaataggaagggcacaacaccacactaaccaacctccacaggatagaactacagaagtaaaagccagccaattcctattgtgcatttcaacaaattgggatttaacgttaattaaggcaacaatggctgtgaaattgatgaggcctagaggatacatagtgttatctgaaagagaactcataccccacattacaacatttaaaaatgtaatgataagagaattcgtagttgccaagataacccactccatgaatattaaccaattaaaaccttgtgaaaggcgcccgtacgaatataattcagggactgttagtagagtcattggtttcaagtctttctcaaacataccaatacatagaaccggtagtgatgtgaatagagtattgaacatggacaatgaccacggctcatatagagaggagcctgaaaacattgtatatctttgatatatcaactgcgtaaagtaaaacgtaatttctttgtaaaacgtgcaaagcataaacttggaggtgcgaatatagttataacgcccatgaacaaataacaatttcaagaggaaccgaaattggccaatagaataatcagatactctagatgcttgcaatccctccttaccggctattccaacacctatatcggcagattgtatcatggcaatatcattcgcaccatcacctattgccaacgtgactaagtttggatcggtatttcttatgttggaaaccataagggctttttgagaaggtgaagcacggcaacatattaccgagtctgttttagtgcaaagctcaacaaatacagacatgtatgtaggatttccttcaaacatggccatcgtggcaccgtcaattacaacaacgcagtgtgctatgtttccggaatcaacttcttgagaaaccgcattcatctttgatataatattttcatcagtagtagttaaaatgactaccgtagaataatctttgattaacatacacgaataccctatatttatagccgtttcccttttatcccctgttagcatccacatttttataccggctcttctgatcttttctatagcttctgaaacgccgtcttgtaacttgtcttcgattgcagttacccctaacagatttaaaccatcctcgatttctgcacctgcctcatcgactttgatttttctatcagtaagggaggttttggcttggtgatagcgtttattccaattttcatactgcccaatatcgatccatttgtaagcatagaccagagttcttaagccttcagtcgaaaactcatcgatggcttgcaaagttctttcaataacatactcttcattcaaaattaactcatcgcttccaatgtgctccaaaatttctgtatcgtaatcatgctgtagtccttcttttcttgtgtctattgggacattgttgttcggaaaatgtgttccatctatcgaaattcgcggcccatatttttctatttgttgcttatggagtgacttcctgcttttatttacaacgctgccaatctcctgatcagatttcttgaccgtttctagaaattgatcaatggagtcaatttgtttctctggatcacgggtcctgctgttcttcattgaaagactttttctcactgcctgcaatgataaacttgctctcggtacgctagacaaagaatttctcaatgaggtcctggccatagcctcttcatctaccattctttccagagactttctttgctggagaaccagctctgcttctgcgtctttacgttctttggtactggtgcatatgtctgccatttttttggcagccaattcgcgatcatgtaaacgctccataataacgttatcagcacctttgcaaattaaaagaacttgatttggttgatttggcatacgtacaagaacagacattctctttctttgagaattgaagtcaatatagttcaaaatttcataattttccaattttgcttcaccgtcaaaaccgtctggaaaagttttaatggtcaaaatctgtgcatttctattcaatacaatataaccaaggtctctagcagcggttactagtgctaattcatctggagatgaagactgatactctatggagtcttctcctattgattcgttatgagtttttttgggaagacagctatgacaaagagctaatgataagaagaaaaatttagccttttgagaaaacagggcggtcggatatctttgaataaactgaattaaatcaaacgaacttttaatgttctccgaaaatgtctcggagggtgaaataaccgaagcttgtttacttagatgtgaattatctttcccaaaaagtgatctcatactgggacggcctgtataaattgctgatgaatttcccttatattcaatagaattcctagatttaggaaagttgtctaaagatggacgatgccctttttcaattggtgcgtccgaaaatcctaaccgatcaagaacattttgatctccaatggaaacaacgtctatactagagccgttgtgagcttttggtggtagtctcaaggagttcgtattgtctctgttgtcttcaaagttatcctcagaattaccgagatctacattatgcagccaagatgatccacataaagaaaatttccgaaatatcatcttattatccgtcagcgttccggttttatcactaaaaatataagatacttgccccaattcctccagaatggtggcagttctcgattcgcatggcgtgttcgtttctgcatggtacatgtctatgtcccattccatcattttactttggactaccttgataatttccattgttacatatagggacaaaggaatcacagtgttatacatgatgataaaagacattattgtgggtgctacgccagcatctgcctgaaatagataccatgctttgttctggtcgatatactttttcttatgcaaaacatggccaagataagaaaataaagatattgtggcaacgacaaacaccataaacacgataatcatatttatcttcctttgtagcttaggggctttcgttcttgggttttttaaagcattcattctgatttttgtttcctcaccactgaaaatgaccataccaacaacattttgagtattcctcaaaatactaccacgataaatgacattatcaggacccagagggtatttcattatggtatcattgcgatggtttttcaattcaagattaccttcaaaattatataaatcaatattgggatcttccacggtaacttgagcattaatatttgcaagacctgatgcggctttggttaacttatttaattctgggtggggttgtttacttttcaaatttgtttcgccatctaaagccatcgtttcaacgaaacattcgctattttcgccgtcacatgtcaataaaagcagatctgcaggtacccaatcatcttgtgtgagaagtacgaagtctccaacacgaagtttttcccacttcttttgatgaatatgaacattgtatttattcttgagtagttcaaagttattgaagtgcgtgtctaagaagtgtccttgagaggagttccgatcatcgtttaaaggtggattattttcagcagcggccgatttagttagatatgcagtggatgagacaacactacttggtagtgtataaacttcttgtgcgtcattatttccatctttaaccaacactcccactggtttattgttctcttccttatctaaacgatgtctcctgaaatcgtcccaagcctctcttgtcatggatatacccataaatacacataaggggataatagttgtataagtaccagttgtagaccatccaggtatcatttgtaatactgcgacaatgaaaaaataagtattggctaactttgaaaattgtgcatacaactgtctaggcaaaaaggaatagaatgtatatcttgatgaagttattcggttgtcgcagtaaggcttgttgaacctttcgtctatcaaatgaccatcccttttagtggcagcttgtttgtattcaattgcattatgatctaatataatcggaatatgtctaccgtctttcgaatggaacgtcctccttcgatctaggatagtatcaagtattttagtgataatgctatatgacacatcaggactaccatactcttccatttcataatcctcttcagcagcataattgccgcttgtttcatctctgtcatctttatcgttattatcgctaccggagaacgtcttactctcatttatatcttctaactctatctcatcatcagctcttccgcgatatttatcatacaaatgcttgttgaacatctgcgttcgtagtgatgaagatcttcttctttgcccatcagctatgcccataatatttttttctttttaataaagaatggaattaaattatctacttcaattaggatgtttatttgctgtatggaagctatgtgtatataacgataaaggtcaaacaaaagaaataacaaaaaagaaaagagtgaatgaatagtccaaaagcaatggggtaatttggcacttgatcttttctcaagacttcctgcaatattgaattcttctttgttaaatattcgcttacttaaagcacttgacagactggggtcgaaaataacccggctgcgcagcccgtcatttgcttctttagaaaatatgattaaagtgtaattagttatttcaaagtacatattaaaatatattatcatgaatcatttcctagtaatccttttaattcatacaaaaatgggatagtttcttctgaagatactttgcatttgctgagaggcctgctctcaagaaaggcatcgtctcttaatggtttttgaaagccaaactttacggacatggaagcctgagcttttcttagcaattcaaaggactttgcagttcttagcctttccctgccttcacggttttcttgagccaatttcaaaattctttcatctaacttgcgtcgtaattcgttgtcagaaagttgcttgaaatctggtttcctacaattatcctttccgataaaatctacgcggtgattttggcgtgaaccggcagaacatccctcctgacagtcgtagtcttcatattcctctagttcggtgtcgttttcaaaagagtcattcaccgattcagcaacatcaatgaagtcaactttcctctctaagctaagaccttgtactgacgaagaacggggtgactttctgcctttgaggatatccagatggaaaccatggttgattgtattggttggggataccttttgtatcctggaaatattgccacaaattttcgaggttttccagaaagtaatgagctcctccaacttatcctcaatgatgttcctatcattctctgttatgccatttcgaatgtcaatagctaatagattgttctcgatcatttttaaataattaagtgcctgaaacaatttatcattctttgaaaatgaacatacattggctctttcacaaccagtattagttgatgtttcttcaggaaatgcatacaatatttgcttatggtcattcaaagacaccaggacagtggagagtagtgaatgtaatcctcttaatagactgactatattttggaatgtacctatcggattatatttttttttgagttgcacccttgccatgtaatctggaaagattttgtttagtgcgtttctcatgtttacatttgaaagattttcgtttcctgtcatatctaaagacagcaaacaacagagcataaatttctttagcagtttgagacgataaagcttaccatcaaggtcttttactgtggtagtattattatagtaaagatttggtacatcgataccgtataattcacagtatttcgatagctcacttgtatcgctaaagatgacaatatctggaatgattgatttgagtttataaaacagtgcatcacttgagaatactaggagctcttttatcacagatgagtgctcgtcagcaattgaaataagagacactcttgatataaaactatgattttttatttctttaaatcgaagatgatatttatgaatcattacgtccacttgttgtaatgattcgagcactttccgtacctttaataaggttttatagcaaatcaaatgtcttcgaaagtattcttgctgaattgataaatacactgctacgagtattaaaattacaactctcgtcagacctggactatttttttttctacagtattttttcaactgtgtaagtactcgataagaggttattatcatcgaaaggtagttgaaattttgtctgaaatataattttttgtcctctactaccgccaatttaccatattttgtcgccataaatggtacagatttgggaggtacattctttaacaaagttgagcttttatgaaagttcataatagattgatcaagatgtagtgataacctgtaatggttcatatcattcaaaaaatgagaagtaatgattgaataccgaaattcttcaaagaattggtgtgttacaccgaatggctgttgcatgaaaattcttgaaataatatcatcccaattaaaaaacttcgttgtttttcctacggttataggtgaaaaagtagagtcattagatcccacaattgtaggggagtattcatgtaatacgctgcggctgcttaatagggacggttttcgccacgtagagtaaaattcttgacgattgttctcggtgacacctattatgttatcactatcaagggttagactagaactcatgaatccatcctcttcgcttgatttcagcatggaaaaaatctgtaaaccgggagcctgcaaggcggatggacgtgagtttgttgtcattattaagttaatcaacaaacgtttcacaagtaagtaaaaacaaacttgttgcaataagcgtgaggtatgccgagcagttattgagggggtgagattttgacctttgataaaactcctataaccgtctagtatccggtagtcacctaatcatttatgatattgggtgaagatgaatgtttagtttattttcagatcaagtgtttttatttacgttttgatgttttcatgcgggatgtcttcaaaaaaatgatttcgcccaggatcgaactggggacgttctgcgtgttaagcagatgccataaccgactagaccacgaaaccatagtaagttggagaaatctgtataaagagtatgttacatttctctaaacatgttaggaattaaatataaaaattccgaaaacttggaggcaccgtctttttagctggccagatagcttgcttacctattttcttgctagtttaaattcgaccggaatagaaatttggttacaagaacgctattgcgcaccagatgcaaattttttttttattttatatagtgtcactggcacccctccattacattgtctaatttaaaataactaaactgatatactcacttactctaacgattgactcctgcttggtcaaaaatatgtatagatgttagaccatctttatatgccattattttgaaaacctaagtgagaagtaagtttcacacttcatttgagaaacgatacacctgcactgaacgatgatcccaaaaatcgttccgacaaatacagacaaacaattttcttaaagattcaaattagaaacatactactcatatgaaagaaaagatgcaacggttagtattggaagaatgacgatgaaacactttgtgttgtttaataggttttagctatccattagatcaggagaaaagtcaccaatgttaaatatgtcgaatgtttctgtatccatagaaaaagagccatttagttgttgctgcgagttactgttttgaacttttacggtacccttaccgccactgtcctttggagtgacattgatgaagtttgtagcagctgaatcaccattttgttccagtttcttagatttcataactttctgagcggtagcaacttttcttgattccttggtctttgttttacccactctctgtttccgcttgggttgaatggttgtagttatattaggagttgtgctggagctagaagtacgttttgatgatggttgtgatactgtgggtgtattattactattattattattattattgttattactattattactattattattattgttgttgttattgttattgttattgttattgttaggcaaaggaaagacggaggtagaatcattttgtggtactgaagtattggttttataatgttgtggtagatgaaattgttgttgcggagcgaacgcatgcattgcggaagaaacattttgatataagggctgcatattgatcatagggttttgtccggatggattagtctgcctcatacctggattttcaatgacaggaggccccatatttcctggttgtaatggcatagcgttgttagctggcgctatacgattagtgtctggaggaaaggcactattttgtaattgctggttagccgccattctttgcatcatcatatgcatgtactgctgttgagatgttatatcactaacaaccggatttgcgacagtgttttgatttttcatttgttgaggaattgttttcatcttattgaagcgggctcgtatgtgttcttgcaataaactattgccatttgcgttattgtcatttgtgggcgtagtttcttccgcagtattgttacgtgtattagattgataattttgatttccaagattttgctgtagtgaattttgctgtagtgcttgctgctgaaaaaacattttcatagcgttcatgtcatcaaacctaccagattggctttgctgaaaagatggcgcctgtccttgattttggtggtgtaattgatattgaaagaagcgctgctggtctgaaaacattgaagattgggtttgtgcattaaattgttgatttgtaggaggcactgaaggcataagtccggttgaatgagaattttccgatggaatatgagggaccatttgtgggttgacaataggatacggtgtctgttgctgttgctgttgttgctgctgttgctgttgctgttgctgttgttgttgttgttgctgttgttgctgttgttgttgttgctgttgcggttgctgttgcggttgatgctggggttgatgctgaggctgctggatctgctgttgagatgattgctggggctgtgctggtgattgcaaatcattgaagtgtttatgtagatttatagttgcgtactgctgcccagcaatatcactgtttatagcagtatcaggtgcaaaattagcgctattctgtttgtcgtagacaccggaagttctcgatagaaatctttcggagacgtttcgattggttggatcgtttaaattaaagttactaccgtcaccattgggcctaaaactctcctctgaaactggaaaactattttgagttggtggaatcacatttggtgggagattagagaaatgggaaggcatattagatttagaattagctggcaaaattggtattattctctctcttaaaggattatgatcctgttggtacccagattctaggtctccattgaacaatgattgaaaaatttcccaccattccagtaaaaacgtgtcattagcgtccatcagcattttcgaaggtaatagcccatcttcactaacaatgtcacccttagatgcaatatccattaatccctgcttcaggctggcgttcaagctagttttctcacccgaagcagatccgtttattctagataaaggaaggtcagcttcgcttaaaaattttgcggcagagttccagtaattgtttttgcttaaatagttataaatatgggcgtacaataattgcttagagttcttagccattgcatccgaaacgaaaactcgagaatccgcatcaaactgcaactgagtatggctattcaaacctttgatattgggagctgagctaaaatccgtgttactagagcgctcatttgtattaatattggtcgtgttatccatatctttatcatgcacctttttcttatttcactgcagtctaacgaaaaattgacaaaagaaccgggagataccaaagggaaaaaccaaaagagtcacacaggattgcaatagaaatctttctggtcttttctactatggtgattttattatacccctcctcttcctgttatacacgcattgtatttcggcattgcctcttggccgcttttttcacctgacgtaatacctgttgcagcaagcgagtttcgtgtgcgtatagaaaagtatttaccttgacatttcgaagaagtatgtaattaccaagtagctcagaagaacacttggtacgtaacaatcatcgtttacctttttcttctatcaaaaaattttcttcttttttttttccttctcttttcttaaataaaattgaaaaattgttacttagtacttcataattttacttaatatgcagtatggatcgttataaataatattcggctacaagaatctttaatcttcgaattcatcttcgtcgaattcatcgtcatcgaattcatcgcttactcttgaatccaaatctttatcgtccattgagttgtggggtagctgattgcgccctgtttcattaacactttgctcccttcgtgattcggtatctgaattcccaagtgaatgtacgtcatttgaaacgtcgatctttgaaacaattcttgttggagcgccggcctttgacacagagagctttttgaactctttatcgatactagtcgcggctgcagaagatgctctcctcgatttagttctattgtaattggagtcttcatcatccatatcgtctaaatatcttagttttggcgatgcaagtggagaacctagctccaaatatatttgttttccaatgtcccctttggacattgtagatttattgggcgtggatcctgagctactatgggaacccaccaggtcagacgcattttctacatcagacgaagcggctaaaacttcgttgttatttgtgctgccgctcacatttctttgcggggctttagtgaccttggcggttttgactgaatttgctctatttctactaacgttgctttgttgtgatacgtcagtatcttcatcgatgttatcagaatcatcattgctaatatccgataagttgtcgatgtcgactaacgggtctctccaaaaatttacgtctgtgaatttctcttcctgattgcctctaaatagcgttttgcgacctgaagtaatttctgagtcaaagttatccaacgttctattagggggggagccaggaaccatggaagtattagttcttagatcgacactgtcaaggctgactggtggaaagaaatgatcgacaagctcattgatatgaatataggagcttctgtaacctgctaactccaataattccatatgaacctcaccctctgtatttattgtgaaaattcttgaactaggtatccccacagttctgtaagataaagcatcagtaatcctattaccaaagccggcaaaaaatggtgttgatttttcctctgtatccatttcgttatcactgtcttcaaaatacaaggatcttatgtcgtttagacacgcgattttgaagacttcaggtttttttagtattacttcccgccttaacgcagccatcgttctatcgggcgataaaatcacaggcccatttggtagtttgctgccattctgttcaattgatcgcaaataactcctcgtggaatcagcttgtccagcacttcttgcagttagatagagtatattatagccattcctagagatctcgctaaataacttggctacacccaagtgcgtccagtcttttcctatcattgccagaacatggcctaaagcgtccgattttgtgatggtgccatcaatatcactgataacaattggaacatcccacctccaaacgaataattttgacgtaacaatagcttttccgtgatctacggaaaatttcagatcattttcaccataagttaaatttaggcactttaactggtcattagtcaatcttatcgttcgtatgtatcttttctcggtctcaccgctccctgctgttcctttcttgctagttttttcacttttactgctttgttctttgctaaatgatgtttcgtcctcagtatcggaaccagaaggtgaagaagataacgaattcaaggtacttcctgattccattgcatctaagcctaaaactgatccgcttgtggccattgttggaggcgtacctgggggagataaatcagtaaggtgctcgtaaggatttacgatcttgatgttgccatttttgtcctccttgataaaactggaaatatctgaatcattaccgaattcgtcctttaacaactgcttcagttgtatgtctgtatcatgcatcatattcttgtttggcttgtaaccttcagtgtctagtagtaagtcgccattgttatcaagtttactgggtatatggatttcagtgagttttttgtttaatttttgctgaaagttctttgtacgctgctcaacaagcttcctctcttcaactgaatctagtggtgtcgttgtagaggattcagtaggagaaagcgaccctgtagtttcactatttttactgcctgaatctccagtgtcattgatatctaaaaaatctggttcttctagcactttcttttccttcttcttattttcattttcaccttcaccttcaccctcggttcctccttctaagatggatgtttcaggtgattgaggggggcttgatgtggcgctcatcacgggcgacacaagcaactcgtcagggacatcagtgacctggtcacccatctcaaaaacgaaataggcttctccagaatcactcagtttcattggcatattactcagtttctcatttataaacacttggactttcttttgagatggctttagaatttgaaatttgccgaacctcacatgaaagggagaacatgatagccttccgtctggatgctccactacaatgacatctatagcacctgatagcgtagccggattgatagaagaccatgttttagacacagacccaagagctctgcctacgtactgcataatcgaccgatgtgtctatcttcagtaatgtcttccctgtatgtttcttagaaggtaaaactgtgattacgaaggtgcagtgtccaattggtctgattaacacttcctgaacacgttttactaaattgttgaatgtattttctttataaacacaagcccccacgatggcctactcttcacttgtccttgctcttccttctaccctcaccgtgcgctgctttcaacgctggccggaaaagccgagaaaaagagatagataatagagaaaagagagcccattgtctaaagggagggaaaccgaaggacgaaaagggcccgcgacagaccgtttagagaatgagcagcacgtgggcacttcgattttgtctcccagtgatgtagtgttatgatatacaagatgagtttggaccctgttcaagcaaatctgtcacatttgttagacttttttttaaacgagccctccaaacaagaacgctcagtgttaggaactgcgaacgaagagagaaatgcgtattaaacttagatgagtattcttgccgtaaatgactatatacaaaacttattcggaagaacctatatctatgtatgtgaaatgataagtacaagacccactgtgatgtgcagtgatggcgaatagggtgaggtcccttgtactgtctttattgtagccgcttgtaggaaaagttttatcacataaaattatcctctagagagttagatgagccagaaatcaggctcttagtccgttggaaatgcgttacttaatccgcgtagggtcatttgatacagaagcaacattatactgctctgaacacttgtccagacgaatctagggccaacgccactaaagaaacctaacacaccttcagattggtagaccgtccgaaggctgagcgaaatcgagttggaaagtgctgccggtctgccgtttgttacatgtggatgtgttactgagtatgatttgttgctttggctgggcggctgttgagtttggactctagtcttaacaacatccattggtgtggtaatgattcccgccagtccacctgcacaggcaccagtcaatatttcattaggtatagacaactcaccatccctaccatctttctgttcaatcttgaaagccaattgcctaaacttttcgtagaaggcaaactgcaatgcactaaatggcaaatctctggctaaagtggctttgtatccaaaaaatagtgagcgaaacccttcttcttttataactgtctttatggcatttcttaaattcgaataattatagccagattgaaagaaaggattattgaaccttccttgcaattgtagccttgtctttaggacctctgatggaacataaacaaaactggagataaaatcgccaagaaatccagcgctcaaatgtgtgatggtatcgttaatctgccaatcttctatcattgttctcttagtatattcataggtcccaaagaagattgccgctgacgggaaggagcctaacatggcagccatgtaaccgccgtatagcccccttctcacgccttcttctagccaaatggtacgatatgcagagatcatgttcctgtattttttgacattgggtgcgccctgttgtcttgtcttaacagtatccaatgaatgcatcgcagaatctcctatttttccaccaatcccaccggagacgacacaatgccatatagggcttaagtcctcatctgaatcgcctctttttttgtgcagtttatcatcttttcggttattatttggttgatctggagttccttctgatgtcgggggatggtcatgaggcgtatgtattatcggtattgaagaactcaggttccatgagttcattatcttttataccagtcggttggaagtgaagattattatgcgtgcttcgttagaatactcagcgtttgttttcggcttgctttgatgttttttcaaattaatgaacacaatgtaagaagtcgctatcgttgtagggtcctagagatgtcaagttagagttcaatcgcaagaaaaataggaatgtgataccttctattgcatgcaaagatagtgtaggaggcgctgctattgccaaagacttttgagaccgcttgctgtttcattatagttgaggagttctcgaagacgagaaattagcagttttcggtgtttagtaatcgcgctagcatgctaggacaatttaactgcaaaattttgatacgatagtgatagtaaatggaaggtaaaaataacatagacctatcaataagcaatgtctctcagaataaaagcacttgatgcatcagtggttaacaaaattgctgcaggtgagatcataatatcccccgtaaatgctctcaaagaaatgatggagaattccatcgatgcgaatgctacaatgattgatattctagtcaaggaaggaggaattaaggtacttcaaataacagataacggatctggaattaataaagcagacctgccaatcttatgtgagcgattcacgacgtccaaattacaaaaattcgaagatttgagtcagattcaaacgtatggattccgaggagaagctttagccagtatctcacatgtggcaagagtcacagtaacgacaaaagttaaagaagacagatgtgcatggagagtttcatatgcagaaggtaagatgttggaaagccccaaacctgttgctggaaaagacggtaccacgatcctagttgaagacctttttttcaatattccttctagattaagggccttgaggtcccataatgatgaatactctaaaatattagatgttgtcgggcgatacgccattcattccaaggacattggcttttcttgtaaaaagttcggagactctaattattctttatcagttaaaccttcatataccgtccaggataggattaggactgtgttcaataaatctgtggcttcgaatttaattacttttcatatcagcaaagtagaagatttaaacctggaaagcgttgatggaaaggtgtgtaatttgaatttcatatccaaaaagtccatttcaccaatttttttcattaataatagactagtgacatgtgatcttctaagaagagctttgaacagcgtttactccaattatctgccaaagggcaacagaccttttatttatttgggaattgttatagatccggcggctgttgatgttaacgttcacccgacaaagagagaggttcgtttcctgagccaagatgagatcatagagaaaatcgccaatcaattgcacgccgaattatctgccattgatacttcacgtactttcaaggcttcttcaatttcaacaaacaagccagagtcattgataccatttaatgacaccatagaaagtgataggaataggaagagtctccgacaagcccaagtggtagagaattcatatacgacagccaatagtcaactaaggaaagcgaaaagacaagagaataaactagtcagaatagatgcttcacaagctaaaattacgtcatttttatcctcaagtcaacagttcaactttgaaggatcgtctacaaagcgacaactgagtgaacccaaggtaacaaatgtaagccactcccaagaggcagaaaagctgacactaaatgaaagcgaacaaccgcgtgatgccaatacaatcaatgataatgacttgaaggatcaacctaagaagaaacaaaagttgggggattataaagttccaagcattgccgatgacgaaaagaatgcactcccgatttcaaaagacgggtatattagagtacctaaggagcgagttaatgttaatcttacgagtatcaagaaattgcgtgaaaaagtagatgattcgatacatcgagaactaacagacatttttgcaaatttgaattacgttggggttgtagatgaggaaagaagattagccgctattcagcatgacttaaagctttttttaatagattacggatctgtgtgctatgagctattctatcagattggtttgacagacttcgcaaactttggtaagataaacctacagagtacaaatgtgtcagatgatatagttttgtataatctcctatcagaatttgacgagttaaatgacgatgcttccaaagaaaaaataattagtaaaatatgggacatgagcagtatgctaaatgagtactattccatagaattggtgaatgatggtctagataatgacttaaagtctgtgaagctaaaatctctaccactacttttaaaaggctacattccatctctggtcaagttaccattttttatatatcgcctgggtaaagaagttgattgggaggatgaacaagagtgtctagatggtattttaagagagattgcattactctatatacctgatatggttccgaaagtcgatacatctgatgcatcgttgtcagaagacgaaaaagcccagtttataaatagaaaggaacacatatcctcattactagaacacgttctcttcccttgtatcaaacgaaggttcctggcccctagacacattctcaaggatgtcgtggaaatagccaaccttccagatctatacaaagtttttgagaggtgttaactttaaaacgttttggctgtaataccaaagttttttgtttatttcctgagtgtgattgtgtttcatttgaaagtgtatgccctttcctttaacgattcatccgcgagatttcaaaggatatgaaatatggttgcagttaggaaagtatgtcagaaatgttatattcggattgaaactcttctacaatagttctgaagtcacttggttccgtattgttttcgtcctcttcctcaagcaacgattcttgtctaagcttattcaacggtaccaaagacccgagtccttttatgagagaaaacatttcatcatttttcaactcaattatcttaatatcattttgtagtattttgaaaacaggatggtaaaacgaatcacctgaatctagaagctgtaccttgtcccataaaagttttaatttactgagcctttcggtcaagtaaactagtttatctagttttgaaccgaatattgtgggcagatttgcagtaagttcagttagatctactaaaagttgtttgacagcagccgattccacaaaaatttggtaaaaggagatgaaagagaccacgcgcgtaatggtttgcatcaccatcggatgtctgttgaaaaactcactttttgcatggaagttattaacaataagactaatgattaccttagaataatgtataacctttagtagtgaatctgcggtatcataataaatgagatacatcttaaacaatttccaggaaacagtagatatttgaaaaagtgcaataaatttttgaaatctgctgttatttgatctaaaatcttcttccaacgaatctactttgtattgaaaaatatcgagctccctccttatagcatccaatgtttttaagggaggtttagaactcttgttcaagtattgatctaaatctctgtctaatgagatgattttccaatacaagacctctgtgctgttttcttccctgtaaacatcaacgttaggcaaatcctgcaaatatgctgcatgttgtaatagggaggatacttctgtatgaagtgcaattggtttgcgtggccccgattgaagataatcgcatccacacaggcgatagaatattcttcccaaggttactttagcgatgctttcaacggggtcatcattaagtaaaggtctaaagtcatccacatgaaaatttttaaaggtatggatgcactgtgttaggagcgaatttgccaacaacggttcatcgtaggggaaagttgtagtggctaaaatcagatatgcttgaacgagccttatatcgggatgcgccatgaaatcacattgtttcaattggaataatgagcagcgtgcaaaattttggcacatgactaattgcataccatcttcccaattgagccttttgttgctacccaaatattcatggagaggatatactgaaaatatttctgctaacttctcgactggcatataataaatgcacatggtaaagacagaccatattagtgcgtcccagtatttgccgtctacactgtgattcttgtctgcccttctatcccagtactgttccaccctcaaatataattcactgatatctccaatggaaccaaaatacaaagcacctaagttttccatagcaaagttcatcaattggaatgattggtctttttgaagataattcatccaaaacatacattcttcagtatcagtatccaaattagctggtgttctagtaagatctctttgttttgttttgtacagcccaatattcgttatccaatattcataattttgccagaataacaataggtcagggagatattccttggaagatgaagccgttattagttttgttgatttcatacattcggagtcctgtcctctcttcctgcagtttccacacggtatcatacgatcacatttgacttttcgcctcgtacacacggaacagggatgcttggatttcagttgagtggtacggttaaacattattattaggatgcaaactcgtgttcgtaacttttgtcatcacctgctctctgaaggttggttataatatttcattctcttacgcttagcttacatggctgcgcgcacttcatttaaagccgtaaaaaataaagatttcatagaatatgaagctttgaatctcatgtaaacatttatataactatgtaacgaattatttatccaatgaaagatccacatggactgattttatttgtaaatagttatcaacgccggtgtcgcctgattctctaccaataccactcatcttaaatccgccaaaaggaactttagcttcttcttgattggtttgattgatccaaacagttcctgctttaatatcgcgagcaaacatgtgcgctttcttgacatctttggtgaagaccgcagaggcgagcccgtagcaagtatcattagccagcttcagagcgtcatcataatttgtgaacttgctaacaaccacaaccgggccaaatatttcatcacgcagcaacttagatgtttctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcagatctgtcccgaattaaaaaaaataccatttgctacccattctatagccttatcaaggtctgcatcttcaaatacaagagcaggagacttaccaccgcattctagtgtgatatccttaaggttcgattggccggaagcttccaatactgagccgccaaccttagtacttcccgtaaaagatattttgtcgatatccatgtgggttcctaaagctttccccacaacggaaccataaccaggaatgacattgacaacaccaggtggaaaacctgcttttttaattaaagtagcaaaataaagtagagatagagaggtattttcagcaggtttgatgataaccgtgttaccggccgctaaggcaccttgcatttttctacaagccatagctagaggataattccatggaacgatttgagcaacaacgccaaaaggaacttttagagtatatgcaaacttgttaaaagtcaatggaatggtttcacccatattgaacttgtcgaccgcccccgcatagtatcttgtaagttctataatctgggctaagtcttgtttagcattggaatggaaaggcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttctaaatgtgtataatctatatctctatgatacaagtccaaggtataattacctggcatgagtcaaatttattcccatccagatttgccattttatacaattagtttctgaggtatgatcagttaaatctacgctattcgtttgaacaatctccctgtctcctccctaaacttactaattccttaacccttagggagtttagcaatcagcttaagaagggggctgatcaacaatccggttcaagtcttggattagcagtaatgaaaatccctaaatgcactaaagggcgtggaagaaaggtactgtagagttctaatagtgatactttccttgtactccagggggggaaggaagaacagacgtcatatgcaagaaaaaagaaaaaaaaagacggaagatctacgtaatggtgggaatagagaaaactaacacgcaagtataatttcttgacacaaaaataaatctcactgagtttatagctctatttttttaccatcttaagggatttctaggacctagtaacaacaattgttccgcatgctgaaataatggtgcttacagttttatatcgagtagtggactactactgtttgctagactgtcaacatattcatccgtcgtcaggctaagctatttaggtacttacgcacttacataatgataactatcacattagttgtccaaagagagatttatgtgaactgcttttgtttgaagataggtatcaacaccactttgccccagttctctaccaataccactcattttaaacccgccaaaaggaacggtaacatcttcatcgttagatgagttgatccaaacagttcctgctttaatatcgcgagcaaacatgtgcgctttcttgacatcttttgtgaagaccgcagaggcgagcccgtagcaagtatcattagccagcttcagagcgtcatcataatttgtgaacttgctaacaaccacaaccgggccaaatatctcatcctgtaacagtttcgatgtttgcgggnnnnnnnnnnacatcagtgaagatggttgggggaatgaagtagcctttagctccaccaataggaaattcagaggtctggaacatgtccaacttttcctcccttttaccacgttctatgtaacttttgatgcggtcatactgtgtacttgatataactggaccaacgatgcatttctcatcaaacggatcaaattttcctgcaacatcccactccttctttgcagtttctttaaacttttcaacaaacttgtcgtagatcgaactttgaacataaactcttgagtttgcnnnnnnnnnnggtacaattctgtcctgaattgtagaaaatgccagctgctatccaatcgatagccttatcaaggtctgcatcttcaaatacgagagcaggagacttaccaccgcattctagtgtaacgtctttaaggttcgattggccggaagcttccaacacaaatccaccgaccttggtgcttcccgtaaaagatattttgtcgatatccatgtgagatgctagggcttggcctacaagtgatccataaccaggaacgatattgacaacaccaggtggaaaacctgcttttttaattaaagtagcaaaataaagtagagatagagaggtattctcagcaggtttgatgataaccgtgttaccggctgctaaggcaccttgcaatttccaacaagccatagctagaggataattccatggaacgatttgagcaacaacgccaaaaggaacttttagagtatatgcaaacttgttaaaagtcaatggtatggttgcacctttgtcaaacttatcagcggacccagcaaaatatctggtaagctgtaaaatttgtgccaaatcacctttggcatttgaatggtaaggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttcacgattgtttttgatggacatgcaatgtaaaaatgataggaatgggccaaaagtatttttaaggattcgctccctttatatgaacattcttgagcaaaattcgggatatgatcagtgagtgtcgacaagattgcatccctaatgtttaaacgagttaaaaaaactcatcattggataggagtaaccaataaagggtatatgattgctattattagtatccaaaagccgccgggaacatcatagggcgttagcaagtaaacgcatggcacgataatggcaaccttgtttcttctggcggcaaaagataaggcaatgcaaaataaaaaacgagaaaaaaaaatgatagaagggaaagataagcaaattttctttcgagctggaacgcttcattttaatctcacgcatttgcaacccatgctgatgtctgaagcgctgacaaatacttcatacgttcttcttgtgacacattaagaggtagcacggaggtgcaagtaaagatggcaaaagtacggaaagtaagaaggaagtttgcgggtcaaccagttgcccttactagtgtacgtaaacatatgtatatatgtatgtaaatatctatatgctgcactgcgatatcgagtaggtgatagcgttgaaaccctcaataaggaagaaaacgttataaattgcaatgtttttaaaaaatggtggctctgcgtaatacagcgcaaaaaaagataactgaccggggctagtgtttcagccttactatctcatgcattttcgtattatatgccatgcatcctgctttcgtaatcatcaaattctgaaaattgttcgggatctctctcgtgatcattttcatcttcgttatcattatcaacactatcgaaagatgcttcatcagtaattaaatttctgctcgttccaataattcgtccgcttattgctgatttatcatttttcgaatgatgttcatcgtccgagtaacttggtggtagcataggtaaggaatctagattaatttcctcattgatgatcttctttccagtgggaggggacatagtgaattcaaatccaggtggtggcggtaatatttcaccgtttcttataattatatcatcattgagatttgtagtactaccagccgcaatattgtcgctatcaccgtctgaaaaatcttcgtcgaaatcattgtcttcaccaccgctttctaatagggtatctttaccgtagtcttcgtaagaaggaggaggtaatttaatgccgtttgactttgcgtatccccattttttaacgtttgcttctatataaacaaagccataagtgccgaaattcacatgaatttgacaaggtacgttggagccaatgatcgggtataggtattggaatttccagccgcggatatgaccaccaacagatttttcatttagtttttttccgttcctggtgaaaaatactgttccactacgtgacctatagccaatgccaacaatgtctcccttttcacactgtggaaataacgttcttaattgctcatttagtttgaaggagtcattaaatcttctggcgccgttagaatcgtatgctatcgaatggtggtgtcttcccggtaacctgaaatatggataaggctgtgtggaaagaccaaatgagatgacacctttcgatacattttcatcactgtttagtgggccatccgtttcaaatatcttgaattcacaataatatactttatttatacacggaatgggtagatttgtggatatagaagcatcataattataatttagaaaagaaacctctgttttattttccactatgacagtatggtttggcatatcaggatttgggctaaactcccatgcataagccccctcttcttgaatatattgccttgtttgctcgttcataatagggtcttcacgggtggtgtctggattgctatcttcggactgttgtaaaagtccctggttaagcagaaatggtgggttctgcttgatatactcctcaccttgcttataataaaactgctcttcaggtgacaactgtgccagcttatctcttacttcatcagcatcgtcaagattgttgggccaccttaaactcatgttttccattaatcttctgctatgaacgtgtgcattattttcgtcataatcgctgaataaagatattctttggccagggccatgctcattataatatgcagttataagccgcgtagctatctgttttgtaaaaaaataaacgatacagatgacgatgtagaccacgattaaggttccaaacgcaaacaacattatatccatgttaagttcgtcagtatcgtctcccccataagatacatcgccacgggggatcaccgaagatctaccacaccgtatttgtccgcttatcgaaccgagaagcagcgattctatcagaaacttgaatgacatttgcttttttatatagaaaaaaaatttggctctccaaactttaagattttttataattattaaccaatgacaatatagataacttgaaacaactcttgaaaattttgtagttaggcaccagtcctttggtttttcaatgttctataaaaaatcactcctccatgcagcagtaaagcgctattctcaaaaatagctcaacctgagagaggaagaaagagcagtagtaaatagagcaaggttcttaaagcctgtatcaatgaaattttgttatggcgtttatatggataacctggaatttgccttttttctttatagcgcaccgttccgaagaaaaaaataaaaaaaaagggccgacggagggttaggtcaaattaaatattgagctaggtttagttatctcttttttaggttttttatatacaaaaaagattatatttagggtacatatggctggagcataatgtctggaatgggtattgcgattctttgcatcgtacgtacaaagatttataggataaccatcagcttcgattattctacactgatgagccctttcttcttattcttaatgatgcccactacattaaaggatgggtacaggatgaatagtcaagtaaatgaagatgctataggtatcaatcttgacctctcactgcccactcacatttcgcctacgactggttcagagagcgccagtggcagtaacgccagtacacttcgcaacgatggaaatgcactagatggaggtcttttgaggacttcagcagcgatttcagcacccacaggtaccagtcaaccaacagaaactattggtgaaaaactgagtaatgaagagcgggtgaactcgaatgtttccgcttcgaactcgacaacggcgggtacagggcgtatgttaagccaatccttgactaatgattcaccgtcgaacgaaatatcgacggatcagttgaagatttttcaaagaatggacgaaatgagtgcccgaatgattgagatggaggaaagcttcaacaagttatctaataagatcgcggaacagaatacaatggttttaaacctaaaacaagataactataaagttatgaacaaattgaatatattacttaagttggttgcgcagccaagcgcgcgcccaagcacaaacaatgcccaaaataagcttgctatcgaattgctaaattcgatatcagccgttagtagtgcttacttgcagaaaatgcagaataatggctctggtagacagcatactgctgatttatgtacaggagattccaacacccattctggtatcaaccagcatcggactacgaatggaaccatagatgtgaatacgaatactgcacagctaaacaaccaattttctaacgcactaaatactatcttacctgatcagcagcataatcgaaataatgtttcccaaaatataaaccaatcgctccctaaccgacaacttggtcctgttataaacacacaagccaatcagaaccagtcgcaggttttaattcataacacaaatacacatcagcaggtaaatcgctcgcctattagtttcccgaacgcttcaactgacaagccattcaagttgaacccaaatgggattaaacggcgcagaagaaatacgcaaagtaacaacaatgcgagcacaaatgaccatgctagtgctgcacaaaagcccatatcagccctatctccattaacgaattctcataattctacaactagcatgaattataccaattcttccattcattcaggcgtcaccagtgcttcaaattcatttcatgacttaaattcattgaataactttggcacgacaacagctttaagtttgcccagcttagccctagataacgcttcttttcccccaaatcaaaatgttataccccctattataaataatacccagcagcctctatcattttcccaattgatcaatcaggatagcacgacatctgaattgttaccgagtggtaagtcaggggtgaacacgaatattgtaaatagaaacagagcttctactctaccgtcgtacccaaaaccaatgacagtgaaaagtaatgtcgacgatgatggctatcaagaggatgatgatgatgacggtgatgacgaaggtgatggaagggataatgaagaagacagcactgctgaggaagatgaagtagatgatgaaatcgaaacagatatgaagaacgcttcgattaacaagcggaggaggagcttgcatcataaaaaaagtaactctttaaacggtagaagaaagcttcacggcgagtcggctactaagcccaacataaactctgatttacattataggatattgaaggctcccactgacgtaaagactatatgggaagagtatgatactggaataagaggaaagccatcgatcaagcatcttgaggccaagtatggtaacaagtggaggctcaataaaaataagaagaccttttcaaggcgaaaaagattgtacaagttcattctgaacggtatggagagaggtaaaacggcacaagagatgatagaaaccttagagaacaaaaggctatataaagatgatgaggatggcgaagtaaagaaaagaaccattggctggttgcaagagagccttgctggaatataggcacgtacgatagtaaataatcgtttacaatcataggaaggaaggaaaaaacaagtgtaacataaatacattctgtaaatctacaaaaatcgttagtgctgttttctttttgagattgaaaagtacgaatcatacacatctcttattctgagaagggtgcatatgacgtaaatcaatgcgtacaaagcggtttccggtgctggcctggcccaccacagttttggcgtggttgattttaaaaaccttcgggaaggtgaaaaaaccactccgaaggttcgaggatgacaaatcgccccttagctgtggccatacaagcttggcaccgacgaaaaagggaaaaaggaaaagaatgtcgtacaagaactcttacaaccacgttgagatttcatttaacaacgcccccctttccattatataagaaggcattaatttttatgtaataaaaaaagaatttctcgaaaatgtcttacaattaattttttcttttgtagagtagggctttaatagactgatatatacggtattataagtgaacgaaaaaaacagcaatgggtttatttgataaagtgaagcaatttgctaacagcaataataacaacaatgattctggcaataacaatcaaggcgattatgttaccaaagctgagaatatgatcggcgaagatagagtcaatcaattcaaaagcaaaatcggagaggacagatttgataagatggagtccaaggttcgtcaacaattttctaatacctctataaatgacaacgactccaacaacaacgactcatatggttctaataacaacgattcatatggttctaacaacaatgattcatatggctctaacaacaatgattcatatggctccaacaacaatgattcatatggctctaacaacgatgattcctacggttcttccaacaagaagaagagctcttatggttctaacaatgacgattcgtacggctccagcaacaacaatgactcttacggttccaacaatgacgactcttacggttcgtcaaacaagaataagagctcttacggttcttctagcaacgatgattcttacggatcttccaataacgacgactcttacggttcttccaacaagaagaagagttcttatggttccaacaatgacgattcttatggctctaacaatgatgattcatatggttcttccaacaagaagaagagttcttatggttccagcaacaacgattcgtatggttctaacaacgatgattcctacggttcttctaacaaaaagaagagttcttatggttccaacaacgatgattcatacggctccagcaacaacaatgactcttacggttccaacaatgacgactcttacggttcctctaatagaaacaagaactcctatgggtcttccaactacggttcatccaacaatgatgactcttatggttcatctaatagaggcggtcgtaatcaatacggtggtgacgacgattactaagtttttggatgtcttcgataaaaaaaatatattattgtgtttagacttaagtatgaaaattttatgtatgagctgtggctatgtatccgctggcaaataggtctgctttttctacactttccaccctcaacctaacagagcccgctggcacaaataatcgatagtaggacaacagagctactccttcttatgccccgcccctttgagcttgttgtattgctcttgatagttgtgtttttcactttcatcagcatcggtagtcttgccgtccttgtcttgactagccattttcttaaaagcgtcactcactacctttgcatcgccctgcaatttttcctttgagctctgaaatatttcgctcactttttgttggtctgtattcattctggatgtcttggttgtagaaatttcttttattggttcattaaagtcaaggtaaatggcgagaactagaatagagttttattctttttaccgttatatagataattctagccgggggcggtcgcccctgagattcccgacatcagtaagacatagtactgtacgattactgtacgattaatctatccacttcagatgttcaacaattccttttggcattacgtattaatacttcataggatcggcaccctcccttaagcctcccctaaatgctttcggtacccctttaagacaactatctcttaaccttctgtatttacttgcatgttacgttgagtctcattggaggtttgcatcatatgtttaggtttttttggaaacgtggacggctcatagtgattggtaaatgggagttacgaataaacgtatcttaaagggagcggtatgtaaaatggatagatgatcatgaatacagtacgaggtgtaaagaatgatgggactgagagggcaattatcatccctcagaatcaacatcacaaacatatataaagctcccaattctgccccaaagttttgtccctaggcatttttaatctttgtatctgtgctctttactttagtagaaaggtatataaaaaagtatagtcaagatgtctaacatgatgaataagttcgctgaaaaattacaaggtaacgatgattcccatcagaagggaaagaacgccaaatcctccaacaaggaaagggatgatatgaacatggacatgggtatgggtcatgatcagtccgaagggggaatgaagatgggccatgatcaatctggaacaaagatgaacgctggcagaggaattgcgaacgattggaagacttacgaaaacatgaaaaaataatgttacgtttttttgggcgcaattaaccaagtccttttatttttttaatggtttatttatgaattgtttatgtttatgttctttatactcaaaatcaataagtgcttattttagcgaattttcttctacgaatatatataagtcatatctaagacttccatccgtgctttattacgtttgtatgatgcatacaatgatgccaaatcagcttgatgctgttggtattcagtcgtccgaaagcctgttgatgtgacactcaaatcttcggcatgtgtgaacggtggccgagcatagttcgtgaacatcatcacttaaaataagaactacactttacatcagcgtggaagataaaggttgttttaagctcaagggcgctggaggtgtagcgcttcggaggaaaataatattgaataacttcgctttttgttccaaattctagattatcgtgtatgttcttgttcgtacgtccatctccatagttataatgagtgggcatgattctgttacaaaaatatctcatatcctgaatgaaccggttaacgaaaaggtaatggtacaaaacgggttccatgaaagctctaaaattgcagacatcgaattagagatacaggagcgaccttcgattaaacaatgggaatcgccgcggagtgctgtaattcctacttcaaatcataattttagcccatttctctatacgcaatttaaatctcgtggtgcagcaccgtttgcacctgaaacaataaaatctgtagatttagttgagctaccggagggtgtacccgcaagagtgtttcatgaaaagacgggtttattttatcaaatatctccacactctattccaacatttattttagccaaaaaagaactcccggaccccataaaattttatgagttagtggaagacttagggtcagtttatggatgtgttaagttgaaaattataccagatgctgacaaatttactcaactaaatgttgatgtagatcgcctctggtttaaagcaagaaaacaatttttcaattcgaatgaatttcaaagaaccaagatagttgatttttatgcgaagttgtataattttcacaataaaatcaaaaagagtactctcacaaggatcccaagtatcgataaacgcaccttggatttatatagactgaggagttgtgtgaagttgaggggaggcttcaatgctgtttgcgaaaaaaaattatgggcgcaaattggaagagaattaggttactcgggcaggattatgagttcgttatcaacttctttaagatctgcctatgcaaaaattttattagactttgacatatatgaagaagaagagcaagctgctcgtaataacgaaaaaaatgaagacatggtggaatctgaaatatttcgtcactcaaatagcagaagtagggacgaagaggagccacttcataaaaaagctaaaatacaccgcgatgtctttagagccggatcgattaatcatgaatttaaaagaatgcgggacataaagcacataaaagggtttccgacttattttaactcgttaactgagtttaaactaggctatacacagtcaacagagaccacattaccgggctatgattttactttttgggagaatggtatggaaatatacgataaaagcaaatacgaaaccaaaacctctccagtatacaatttgagacagtattacgaaaaaagtctggctgttttcactgctattgtagcgaaatttgggagtagctatcctgatttgtttgcgaaacacacaacattacctcaaaaggaattcgagaggttatactttcatttgctatcggagcactttatagatttcgaaattgacaccggtcttggactaccctgttccatgagatcaccaggaaacaactcgtccaatgaaaagtttgccattaagaatattctagaccagtggaatttagacaacattcctctcaatgaactatcgcttttacaacaccttgatctggatatggccaattttacgagaaccacttatgatattggaatgttgttttcttgtcaaggttggtctgtttcggatcattttttaccttcaattgatttcaatcatttaggttctaccaagttggtgtacagtattgcgccgaaagatatggaaaaattcgaagctttaattgctcgaggaaaaagtgaatgggatactatccaatcaaggccgcgctactccacctccgatgacgaattaaagagctttatagaaacagatttctacaagtcatttttggatgcagaacaatctgctgactattcaaacactggagataattcaaaaaattcatttccagaagataagatagcaggaaacactctacatgatggttcacaaagcgacttcatatttgagcctaatttcatcttagccaatggcataaaactttataagacgacacaggagcagggctcatacatttttaagtttccgaaagccttcacatgttctattggatcaggtttctatctatcacagaatgcaaaatttgcgccaagctcctggttgagattcagttccgaggcagcaaaatggacatctaagatggggtttcttcccggtttagatgtaaatcaattacttatcaatgccctactaaactccaataacccagttttaaggaaaaaatgccgtgatttaataagtaactacgtcgttgaggaagcggaaaacagcaaaaaattaggggagttgattggcactgtagatgtcgtttataataaattgaattatatttcagatattagtttagagtcaactggtctttcaaaaatcgttgttacacacggtgcattgcaacgtaatttatctctgaaggaattcgtggtattgctagaaaaaccagaaaacggtgctcatagtatatgtggcatcccaatacgtgatcaatctggtaatctcaatgtttgtttgcactcatactttgatagcgcaagcctaggaattgctctcgatggcttggacaagcctccgacttcttatctgcttgttcacaatgaagattttgaaaaaaagtgggacgtgttaatgacttctacttttagaaatagaactgtgccattaaatataatacagtatttgatctctcatactgatagtaatactgagtttaatcgaatgttacgctccaattttgatgattcattactacttattgagaaatgtaaaaagtttattaagaccttcgtggatgtttcctgttctgttaaagatgtagatttcggaaacggtttcaatttacgtcatctaccgcttaagttttctgacaacatggctgataatttggagagcttgtatgaaagtgtgcggaagtgctcaattgaattttcagaaaagccgacaattatcagactgtatcacgtatctcggcagtttcctatcgataatagagatattattgatggcaataatctagatttgcttaaggaattatatcagaaatcgttaaccatcccgttgaaggtttcttattggactaagttgaccagaaaaatatgtaggcttgaatggttatccgtttatgaacatatattcattgagcgatgtgatattaagaatgaagaccctgcgaaatattcacttccactgttatattcttacttcgaatttggtttgaaatattgtgattcggaagatatagataagttaggggaagtgagaaagctgattttaaaatatcaggacatgatgcagaaagttcgagtttttctaaaaaaggatccaccctcaaaaatatcgctaagtgatttagaagacgttttattagatatagaagaatatcggttacccatacaaagtagttttttcagtgagcttgattatgttattagagaaattgaaaatgcaaaaaaaatgaacgatgtgaatattctttataacactgataatattgataaaatagacgaactcatcaggaaaaatgatcctaaatttgtgaagtttgcgaaccagtttaatggttcgagattagataagagaccgctggccagtgataattcaggatcagtgaaagccaaacaggagttaaaagttttcaaattatggaaccagcacttggatcaaataatgcaaaaaaataaatttattgagatactgccgtcgatttttagatgtttagatttgaagtcagacaaatacattcctttggaaagttgttctaagcgccaaacgaaatattgcttttgtagaagggttgaagaaggtactgcaatggtcgaatgtgaaatatgcaaggagtggtatcatgtggattgtattagcaacggtgagttggttccacctgatgatccaaacgttttatttgtttgctcgatatgtacaccaccctgtatggccgttgacaatatcgaaggtgtgacttttgagcttgacgacttgaagaggatcttagtagaatctttgaagctaagtttaattccagatccccctatcttgaagaatctctttgacgtttttgcgtttgctttgaacttcaaaaatgaaatggaaaaagaactatttactaacggttatgtaaatcaattgtcctctacgcacaagatcaagtattacttgagaaagttaaaagggtcacaatgcggctttactaatctgacggatcccttaaggaaacattgtcaggtgaaagatgcagaagcaattaaatggctcacagataatggaagaatcataatcacaggaattccaaattgaaacgtaatactatcttattgattaaaatcactatttacttatctaaaatgtacctgcgaagtctgcatgacatattctctcttcttttattgcgcatacctcgtttactcatactcagatgttctacgacgttttctatggttggcagtagttacctattgttgacactccagtattgggtgtttcccatccagcataatcccggtaaaaaaagacaccccagaatctaggagagctcctttcgaaggtggaaaagcgcgttttgctgtcaatattgatgtttattagtaagtgtttaccgtttcttgatagctttccttacgtaacaattgttcttctgctttccttcgtaggaggaacgcgccaaggcaatttttctcgagaggtatgaaaaaaataaaaaaagctcatttccatgacaacttcaagtaattgaccatctataggaaccctaagacttttggcaacttcgacttagagctcttttttgtggttttgttcatttacgctaaataactgagagtttaaatttattgatttatatattattgcatcacacaaacatcgctttctttttcgcatttttgacaatgttaagaatctgcgtaaaaaggccctgtataaagatcgttctttcacaagtacgtccagcattactagtaaggaaggagaatctccacataagtactggagtaaaagttgaaaagagcagtataataaaccaaaaggaccctaataaagtacgcgttgagataaacgagttaaagagacaagctgaaattgaaaaggctgcaataaaggaattggagaaaaatcctcaataccaaaaattagctgaagcattcaacagtcatgatcatgttcatttacgtgaatcagagaccgagcaaaacgacataatttcattgggcacgatacgagactacaaaagcagtaaatgtgagcaagctgataagccttcgtcgttgaatctgcattcgcatacacattctcatggacatacgcattctcatgctgctcacaatccattattagtacttagtactgagcaaattaggaaaaatgcaggcgtaagaatcacatgggtcggcttaggtgtaaacgttggtattgctataggtaaattttttggaggtatcgtatttcattcacaagcgttgtttgcggatgctatccacgcaataagtgacatggtttctgacttgttgactttgctttcggtagggctagcagccaacaagccaaccgctgattatccatatgggtatggcaaaattgaaactgttggttccttggcagtttcaacaatattagccatggctggtatatcaataggttggagttccctttgtgcactcgtagggcctgttatcccacatacaatcattgacaccataggaaacttaggtcatgctcatacttattctgaagacattattgaagacgttactgatatcaacgcagcctggattgccgccgcttccattgcagctaaagaatggatatttagagccacaagaaagattgctatcaacactaattcaaatgtactaatggcaaatgcttggcatcaccgtgttgattcattaacttctcttgttgctctggttgcaatcagtactggttatttggttaatatacaatcattagacacgattggtggtttaattgtttctggtttaattatcaaggctggtggcgagggtatgtgcatcgcaataaaggagttaatcgatcagtcagtttctcgtgatgatccacgctacctagagatagaaactttggttaaagatacgttgaacaaactgatctctaataataattctcagaaaccctatggattgaaagaactgacgttactgtcctcaggaccgaatttacgcggacatttaaccttggaagttcctttacaaaaatggggcaatattttaggtgttaacgagtttgaaattgtgacacatcatttacgtaatgtgttaaccaatgaagtatcgaatttgagaagactggatattgaatacgtggaagaaaaaaatggtgaggaaaatgagcatatcaagggacaacaaaactacaaagaagatgttcttattaagcacgaccatacgaatactcatatttgagcttcccacagtaataataacaagtgaagaagagagggaaatgtcgaaaatacccgaaacgcatttcacaattacaaaaaggccaaaaaaaaaaaggaaagacaatacgcttatatttgtcacgtatacctactatttgatttatgtacgttttatatacaaattgcatttactatttataaaataaatcattaactataatactctaactgaatgttttaggatcttctctattaaaaatatacgtggaaaacgactatggctgcccgagagactaaaaaggaaagagcgagggatataacaatagcagtcattactggtgataataatgacataaaagaattactgaaggaggcaaagtatatactgtcaagggtataatggtgaaagtaactgcagcttgtatcataattggtgatgaagtgctgaatggaaaagtagttgatacaaattccactttttttgcgaagtattgctttgatcatggaattcaattaaaagaaattgcaactataggggatgatgaaacccagatcgtagatactgtgagaagattagtcaaaaattatgattttatcatcagtacaggtggaatcggccccactcatgacgacatcacttacgaatgtatggcgaaaagctttaatttgccttgtgaactagatgaagaatgcaaagaacgaatgaggcataaatctgaccctgaagcaaggcttgatgcagatgctctaaaggcgcattaccaaatggcaaccatgccaaaaggcacaaacgtcaaaaattattatgtgtgtgatgacttgtgggtacctatttgttctatatctcacaaaatgtatatactacccggtatccctcaactatttgcaaggatgctgaaagcgttcactcccacgttgaaaaaaatatataatttggacaaggatccacgtgagtatgttcgttattttgtcagaacacacctaactgagtctcaaatttctaaagagctaaagttgattcaggatgaatcaacaaaagtttcagaagccattaaaataggctcatacccacattttggtatgggattcaatacagttagtattttgggtgaaaagaaagacgattcatatctgaagagtattgtcaatagagttgttaataacctcgagggagaagtaatttcttctgaacttgaaaacaagttctcgaaccaggagagctgaatacccgagtatttagaactatgtatagatatagattttttttttgggagcaaagtcatctcagtcatcgccggtagttgcgctttcttctcaacaaaaaagtacactgctcgtggtagaaaggtaccttgaaaaattaaagatcacattgctactgttagagcttcaatcgctaaagtaaacatttgaaaaatgcatatccgaaaggaccaaaccagcaaaaggtatataattcattcaatagatacaactgctccatgaaaggaaaaaccttcatttacggtcgcgttttttttcgtgatataaaaaaggtaaaaaaaacgcgtcgcgttagaaaaaaggtgtgtgtgaagagaaagacccattgaatggagagttcggttcttgggaattgcactgagccgtggtgagtttgttgctttactacatctcttcttttataagcaacgcttaagctgaacctagtcaacacacataactgaagtcaatttgaccaggtgcaactgaaacctggattggaattggtattcacttgaacaaaagactctggtaaaatgtctgaactctctcaaatgacattgaagatcctttacacattggataatggatccaatggtagttatttagcccgctcaagggctccaaaacaggtaagagttgctaatattcctagtccattcccgacagattcgaatgagcaaacggagttgcgaattggcgccatccatttgaagactatactgcatgaaatatacttaaattcacctgaagtgttagaccatgacactttaaaagatggatatgattataacttgtattatcgtgacatatgtgaagtggatgagccattagtaagccttggtcttctttccgggcttcgaaaaaagtttcataagaatagcccctaccagtatacagaaaacaatattggtgaagaagaaagtgaagagagagatgaggtaactgaagaagagtatgaagatgaatcttttatagttactggaagggtatgctcgaatgtttccgctttactacgaagatcatatagcaacatctcgaataaaaagggaagggtcgtaaacaaccaaattccggaagaaactttggaggttaaactaagattcacaaaagttataaccaatttaaggacgtctggtaacaatactacaaattctcggatatcgtgtcttcaaatgccgtcttctttaccatcagcaacacttccgtttaccccaaaatcgcaatctcttttcaagacaaaccaaataaaaaattcaaggaatgcaaggaccacgataacaataaataatactaatagcgggactgtgggaagaagacagacgaatcctatgcctgctccaaaagctgtcagaactcagtctttacccatctggaatcttaaaccaaatatagcgaatactggtttcccaagaaattcaattgcgcacaaaatctacttagcagatagaaaaacagaagccaatcaacaaaacaaccagcatcaaaacatagcttacgaaataaatactttgcaaaacgataatactattcagaggaccaagatcgatgattcggtaagcaagaggttcgattttatgctcaacaaaagaaagtctacgaaaaaagtgtcacctggtatagcaacgatagcaaaaaaaccagcttcaataaacataaatccaaagcaaccgccgaagactagtggtgaaaaaaaagcaaatgataagcaaacgattgtcaaagttaagaattcgaattccaaaaattcggctaagtctacacaagcaggatgtaggcgatcatcagtgatagaacatttaaatgatcatgacgattcaattttaagtgacattctatcggaaccaggcattgaagggcagaaattgcagcaaaaacaaaaggggcgtaagatatctttaactagtgaaaatgataaagaaaatattccaccccaaagcataactagtaaagagaacaagcttgaaggtgacttggattttaacgctgagttccccatgagtgacttttcggatgtagtatttaaagatgagatgggatggttttccaatttcaattgcaatttttttgaatcaccaacttctgcaagtgcatcacaactcaatcagcaaaatttgaagccttctataacactcaacgatccaaacacctgtaacaccattgctctcgaaaatgaagatgtcagtgaattggaaacagcgcaaaataataaaatatctttgcctagcgatgttgacaaaacctccccaatagactcgttgtctatacctttaattgaacttacacattcaagctcgacaacaaacatgcagcgtatatccattaaagaaggatcgacactaaatataacagatagtaataatgccaccccatgtgataatgatataaaagatagaaaggcatctgtaatagattcggacaatacaaaacctcaggcagggcttataaatttctctactccagctgaccagccagcttctgataataatgttacagcttcgaaaaagcttactagcatgctggaaactcagcaaagtaagagatctcatgaagaagttttggatgaagaggaagaggaggaagccctcaaaaagcaaaaggcaataccgtcttcaccatgtgggatgttcaattatcatcaacccatggaattatctgaggacatagttgaagaagagcaaggacacaatatcggcgatgataatgaaagcgataagaccaacgatttattctcaacattcatccattcaggaataagagtaagtcaggtagtaacaagtcccatcggtgaatttcagtcaataaaacactgaaaatattacatgaacttattcctagcacagcatgtatatatatatatatatatatatactcagatcatacatgtagcaccttatagagaacaaaaagaagtatttaattagcattttcatgtcgttaacatgttatcgcgttctgcagccttacgtataaggtcgctggcattcaaaaacgagcacatatactcattaaacttctccctatcattagcggaaattgtctccttgaatataggatccatttctacctccacttcatgggacgtgtattgatgggagttccttcgcgtggtagtaacctttgtcaaatccaagtgtaaaggcattttatcattaaaggtgtaggtggaacggcttttggttctttgtaaaataaagccattcctgaaagcggcagaagtttcgtattcaggcacttcaaggctgatgctaattttagcgtctaatgaactttgaggatagcgaatgagaaaatccttgacccggacctttttgatgtaagtaagtttaagttctttgtttctaaggtcttccgaacaacgccatgaagttaatttgccaactttcgaggcattgttgcagttatatatagaatctttcgtatacttttgtacctgttttactactcttggggcacatttacttggattctccgattttgagcggagtagctcctggaaactcgagaacatttgctcaggaacgttagacactaagcggccatttctgttttgaacaataaagggcttgttgtgtggtgtcatcctgcgatgtgtccttttgtctgttataacaccaaatttcatttcgatttcaatgtgtgatatcgacgatttatcaatacaagcaagatatttccatgctaacttacaaacatgtttatggaattctgtcgcacctcttgaattgtttcttgtggttttgtataaagctctagttgatgttaatggcttagtggtttcagagatatgcaagcttctgaatttcgaggcaacattagcgtcagctttctttgcgccaacattttcatgagaatttctactattggaaggagtctcgggttggtcagacatatcttaaacttcctatagtgttttcatttttccttttcagtgctttttttttctttcccattttgctggtagtcaacaaagttgtcttaaggaaaaaaaaataaagaaaatattgaaaactaataagtttttttcctgtaaaagtgtataaaatatataggagatcccgtcaaataatagaaaaaaaattttttgccacatatacctgtagccccaggaatactgaaaaaatggagtaaaatgaaatgaacaattcgtcgtgaagaatacaaagaaatattaaagaaatttcgacgtaatacatagttcaaccgattaataagaaatacccagaataataagagaaagaaaatgaaaaaaggaaaagaagccccatgtctgtagtgaacgtgttctcgttagttattcagaagaagctggactgaaactcttcgaagtgtagggattgaacttaactatcttttcctctttaggagtggaggaatacgtttgggagatttgtaactgggtcaatagtgcttgttccatgtaatacttgtcaatttcctggtataccacttgttcttctggggtgagcaaacttcttggacaataaaagatgtcgtcttcgaaagttttactgatgttgtttttgtacattatggtgttcatgccgtcttgttgggtagtgaattcatcactagaactcaccctactgttgttggcagtgttatagctgaaaatgcccgagttatttttactattgggtaccgagggagaagaatagaatgactgagggctggtgaggttgaattcatgttgttggatgctttccgtaaggtagaggcttgtgttcatttttgcttccgcctgcaaaagtggagtcattttttttttgttctgaaatcaggagaattagagtagggggaaggtgagtaaatataaggggtcgaggaacaaaatccttataaacaatccgtagagtaaaacgctgcttgttatcttacagcaatgtaataacaagcaagaaagataaagcaatacgaaccagttgctacttggtggcacagacgtgcgaattaattaaggttgtgtggacaggaaaatagcgtttccctcgaagggtattgttcttgttctttttatattttcggcatttttatgctcggcatttcccaacagaagcggatatattttaagggcgcggagatgagccaaacggcaagcgatatcaaaatatctgcataataacggcaatcaacgcgcacgcgaatggccaagagggtacaatagcagcaatgatgcggcttgtgaaatggaggagtgggtgcggtagagcttatttttttgcgtttggtgaagcgtccttggcctggtcaaaactttgcaccttagacggcgatgctggagtgtcactgctatctggagggagctctacaatgttgtggttttgtatgggagtgtggttcaggaagagtggttgcatatagctgtatattggtagtggaggaggctgatgcggcaatggtatgggagcagatggcataggatgagggaagtatggtggtgcgtaaagagatatagtgtcttgtgggctagcaggagttgatatgggcagattgtatggaacaggcgcgggctggacaacaattccatatgggcgtaattgcgggaacattcttgttgcgttagggtcgttcgcagtgctatttgcggactgctgcagtctacgtaaggacatcaaatcaacgtccgaatgaacagaagattgatgttgtcttaagttatcgattctactgaagaatttaaggcagatattgcattggaatggtttctcccctgtgtgtttcctgatatgtctagccaaatgttcggtcctattgaaactcatgttacaatcaggatatcccacgcatctataatttctcttgacagaagcgttgtctttgttccttttcggttgttttcctctcatgtttaaccagtgtcatgctaattgtcctggactatagacgtgagtggggaggaatagtgctatgaagtcgcaattgaatcaagaatacacgaaagaaagagaaggaggcgtctgttcatatacacacaaacaatagttgaaatcaagaagatacaatgaaagaaaagagaaggaaaataatgttataaacgattgaagggatccgctgaggaatgaaaaaaaaaaataagaaagtaagagaagggaaaaaaaaaagaaaaaaagaaaaaaagaaaaaaagaaaaaaagagggaatgatcgaagataaaaattctcagaaatttgagaagaaggaaaaactctacttaaataaagataaacttttcatggcttgagagtccggcatccacgtaacttaatggtccgtgcggtaacatggcagggtgtgcaggaccctatggctcgagaagttgctaccggtgtttaattttttttttatcttaatattaggaagagaaaaagcatcagttacgagactcctgaaggagcgccggaaagnnnnnnnnnnnnnnnnnnnnnnnnnnnnnnnnnnnnnnnnnnnnnnnnnnnnnnnnnaattttttttgtgtggggaaagaccgactaccagtaatactttaaagatattattaaaagaaatcccgaaaaaagaaagaccatgagaaaaccgagtgcgtttcatgcatgtaacataatatttcttcccctcgttaagtgtgcatcagcaaccataatgctgaattaaccgcaaaggttaccataaaggatcgcatataaacaaaactcgccctttctcctgcatcccttaccgaaaaggaaagtttatatacacttaaaggaaagtgctactgtaggtcgtcaggccgttgatgtactgctcttcgagacaactattgtaccttaactgtaagaatttgctcaagccctcaaaaaacacaacgtgcgggtaacgacaacgaagtgggcgcaagacaaagatggaatatcctatccgatgggcactataaaaggcgaagggaaaattagttttttttcttgtcaagcatttgccgagcgcttcaatgttgattggtctagaagtaacaatcaagacagataaagtctagtacgtgtgcaggttaatgcgcaagtgagaagtgtagatattgtagttgtgatatttactattctaacttggcgctattaacgctttcacaacccaaaaacatcaagaaaagcctttcaataaattgctcttctcttggcgaaagaaagcggggggcaaaaagaatcacgggacttatgtttcgggatctctttgtttcttctttttttcccggagaataattttttaggaccaattaccgtagttgcgactacaacaattgttgttcatacccccacgatttactttttgaaaactagtttttggaataataatgttgtaaaatttccctttttccaccccgatttgtattttatttttcgttacaaaattgggactaatattaagggcgacagtttttcttaaaagtaagattttttacttaaaaattcttgttcttaacgaaattacatacgtattaaaattatttattagatagtcggtattgtctttttgtgaaaaaaaaaaattataatactaattgttaaaaaggcaggtatgaggagggtatagtaggaaagagaaaagacgttacaatttttaggttttcggttttaatagaaattgtttgattacacataataggaattggggggctggcgggagggaggcgcatgtgctctattactttcttgtttccacaacggatggaacaaccacaacgacaacaacaatagcaaagataataaagcagatgatcaaacatcttattttgttttttcttgcttttctggcactcttaacggccttgttggtgtgacccacaccttgctctacatcttgctgagcgtcttcgacgtttttgtcaatgacatccacattttcttgttgttcgatgaccaactcttccatgtcattgaacaattgggtaagttcagccattgttttttccaacttcaacaactcttgatgtctagcctgtacttcggccaatgctgtcttggcctcaccacgtctattggcgtttagcaacgcttgggaaaagatctgctggccattgacatcgttgatggcggcttccacttcttcgtcagtggcttccggttggataattgtgtactgtctcttcgcctgctctttgctttcttctttgtagttagaatcgataattctgtagtcttgaattaattttaagaatttctgtctgcaattttcagcttgtgcctgtttattagagtcgtgcaatccgtctctctgggcatctttgatatccgctttcaattgatactgcaaatctgtggcctgagagatgtaatcgtccaaagaacgtctcaattccatctcctgttcctcactcacttgagtaagtaggtctttgtgttgcgcatcaatttggttgataatgttttcgtacctggacaagttagcatttattgagttgatcttgttcataaaagctacgaaatcgtcgctaccatctgagtgaccagtaggagcattgttcaagtcctcttgcatttcatagttttcagcgtacggattgttattctcataaggattagcgttgctcattgctgcaatatttgtgcgtgtatgggcagttttcaaatgtaaagtattacaattccacactattccagctctcttatgggtatattaaacgatttaacctgccaacagcatttatttgtcattttacttgcttttttcatccatccattgaaactaaaaacgtcaaaaaaggccatttcgtaaacaacggccgggtgataagcacgtcgtttaggggggaccctttgctgccgcttggtacccggctcgtaagacataaagatgccacatatttacttttagctggcttctttattcacacaggctactcataagagcttcagtagacgcgcatctgtcggttcttcgtcaatctatttccgcacatactattacgtacgatggctattaaaccaaccaaaagttttcagaattgtctagaagctgaagtgcctggttataacgactgtccgacagttttgttttctatcgaccctaatagcggacctagatccaaatctaaacaaagaacgaaatcgaaaagatgtgttagcggcagacttgccacagaagtgttagatctttatgggaacactaaaacagctactacgccgccaccagttttgaggaggccatctgtaactgctgctcaacaagaatctgcctgtgaaggtgtgctcgtaaaagaccaaggcgatagacagctccagccgatattatgcagtaaagaagaattagtggctaagatcaacgacctctgtgtgtgtggctcgaagctctcttcgaaggagttggaattttacaagaaaaaattagattcaaacattaccaagattttacaaaacgagcacaccaaaacagtactatcccagattttcaatgaaaaagacaaaaatatggccgtgaaaaccattaaacattggatggttactgacacaacaatctcaaattggtgtcccgcattcttaaaaatttttgaaaatgcgatgcctaattaatcaataatattattatatttataaatagaagtacactacgcagaacattttattttctaaaaaaaaaaagaattcctattgaataattaaaaatcaaggttacccgcagtctgcttgagaaatttaataaaaaacatgtaatcatctcatcgcgtcgaacagcatatagcaataagggctcatcaccgcctcatgtttcttcttgtcatatcagatcaagaaaaacaaaaggttggaaaatgaatgaggataaagagcaaaagatcaacatacacgatatattgaatacaagaccgaagctcaccaaaaagacagccctagatgttttcttcgaagatctggatgacaatgtaattactcccataaacgaatatgttcttgattcaggctcatcatcatcctcttccatttatcaggcgttgaagtgctcaaataacaatgagtttgttgcagtacttttacagaaattccagaatttgcacattcacgtactagaacagcaacggaggctcatcgaaagtaaaagtgacttattgcctatctcattgcatgatatgaaatacgtagacgaactgataaatcttttgattattcatggtatagatgctaatttgtctcctacgatgaaaattccattcgattcgaaaagaataaatactttcaagaagggccaaaaaagcgcagaatatgaaacgcctcgatggcacaccataaataacgatactttatctcaagtcataactgtcttttataatgttctaactagtgagaggtcttctgactacctgagagaaataatatcaaaaggcagtgcttacgcaaacattttattaggtttgattgtgttacatttgcagttgcctaataggtactcttcacaaatgattacaaatctagaagatactcaagaaacttatactttgtttggggtttacactctactagtagaaacaattcaagacgaaaaggttagggagccaatcctttcgaagttaacaacgttaactctacgaagaccggaaaatggtctgatcagcttgattgatttcgttttgggtgtgagagatgctgaagatatagatattgaaaagtttaaccgtatctaccaaattttgatgagtaagccaaaaacaatgacaaatttgcaatacttgacggaactattcaagcaaatttatgatggtctcacctttgtgaacaggcctatcctggtcacttgtttgaacggactaatccttaaattttacctgaggaataagaggattgttaacgattttttgtttaagaaggtccgctccattatctttaattccccgttaactgatcatacagcaaaggaactgaacgatgttataaacgttcttatatctttatccaaaaattcttcatcggatttgctgaatgatttagttactagttgccctgatgaagacggtactacgcctggacagttctttttatatgtatggatatatgctctttttttgaagaaaaaccaaaaactagacccattagaaataaacaaattgtctatttcagataataaaagcacagacagcatacattttccagagcaatcttcctcaaagtattacgaggttgtattatcattattaaaatctctaatagtcataacagaaaattttcaatatctaaatgtactgagccttaacttactgaattttgagcacgagaaatggaagtatttaattgatcttgatactcagctaccctacatatcggttaaaaacacagatatggcagagttgtttttcgaaaaaggatccaaaaactctcaaatttctgagtttcttcaagatatggacctttcgatagaattatttatggaatttttagtgctgctaaatgatgaggaacaatcaaagactttatttttagatattctgaaaagatgggtccatcatacaaaaaaaagtgaaaaaagatcttccgataatcatagcgggatgccaagcgttacagataacgcgttaatactcatggacttgaaacttttggaatgtatgaacaaccgatttaaaaccaagattgttaataaacctaaggacgttcttattgttattgatcaattgatagatgttgttcaggaaaaagatgaaacaatacaggaagtagaagcagattctgacgacgaagttgaagaaggagaagaaacagaagaattggatccaaatgaaaattcttcctacaaaattatcttgcagttattatcaaccgtcctttcagaatcgtccagtagtatattattgcaaaacagttatatattgaaatccatttctagaaaattacaatctttcaacactaatgcttccgaaatagatgcattattggcatcaatagataatatattgattaacggacatactacggaaaggaacgacaacatagaaattgagatggatgaggaaaggcttgacaaagcgataactagtctacatgatcctttagtgcccataaaatcttatggtttaacagaactacgtcatctagctgaaaagaagtctccagtaatttcactggaaaaggtgttgcaaatacatttagattatttaaagaatatggaccctttcatttatctcaacgttattaaaggacttacaacgctatgtgaattagagccagaaaccatattgcctctacttgcagaattttatgctaacaaaaaaaagaaaaacagattagatgatgtgctgaaagttggagaagtgttcatcaattacattcaacgtcagaacgaattgttccagggtaaattggcttatctgattatagatacctgtcttagtattgtgaggccaaatgatagtaaaccattggacaatagatggcgtatgtcatccatgtcaatcttaggtatgtgccttcaaatcaacgccaggggtgtctcggatagaattcgcgatatgctggattgtgtatttggaatattgcaattagaacaaccacaaaatcatttgaaggacaaggatgattcttttttgatgagaagaagtgccgtacacttgatacatgatttgttgtacagtacaggatttgatttacttccctttgagtacaactacgataagctaaaaacactattatcttacgttcgtgatcaagatgaagattacatggtttgtgaacagattgacaagcttttaaccgtactagatagtttataacccattacgcatttgattataatttgcttcttaggcaaaattaatatttacgttcttttatattctttctttttgtattcatagaacagcagccattaccaatagaaagttaaaatagccgccgatgcattttattacccgcctttctgttttctgggcacttttctttctagaaggtgaaagaacaatttttctcgttttctcgaacttccaccaagcgttgggtaatgagggaggagatttgtataaaaagagtggcatgtgaactgcctaccgtaagtgacatgaacacatgcattatattttttgtgatatattctttctcttgttttctttttcttgaaacgctacagaaccaatagaaaaatagaatcattctgaaatatggctggtgaaacttttgaatttcaagctgaaatcactcagttgatgagtttgatcatcaacactgtctattctaacaaggaaattttcttgagagaactgatctctaacgcctccgatgctttagacaaaattagataccaagctttgtctgatccaaagcaattggaaaccgaaccagatttgttcattagaatcaccccaaaaccagaagaaaaagttttggaaatcagagattctggtattggtatgaccaaggctgaattgattaacaatttgggtaccattgctaagtctggtactaaagctnnnnnnnnnnnnnnnnnnnnnnnnnnnnnnnnnnnnnnnnnnnnnnnnnnnnnnnnnnnnnnnnnnnnnnnnnnnnggtcaattcggtgttggtttttactctttattcttagtcgccgacagagttcaagttatttccaagaacaatgaggacgaacaatatatttgggaatctaatgccggtggttctttcaccgttactttggacgaagttaacgaaagaattggtagaggtaccgtcttgagattattcttgaaagatgaccaattggagtacttggaagaaaagagaattaaagaagtcatcaagagacattctgaattcgttgcttaccctatccaacttctagtcaccaaggaagtcgaaaaggaagttccaattccagaagaagaaaagaaagacgaggaaaagaaggatgaagatgacaagaaaccaaaattggaagaagtcgatgaagaagaagaagaaaagaagccaaaaaccaaaaaagttaaagaagaggttcaagaattagaagagttgaacaagactaagccattatggactagaaacccatctgatatcactcaagaggaatacaatgctttctataagtctatttctaacgactgggaagacccattgtacgttaagcatttctctgttgaaggtcaattggaatttagagctatcttgttcattccaaagagagcaccattcgacttatttgagagtaagaagaagaagaacaatatcaagttgtacgttcgtcgtgtcttcatcactgatgaagctgaagacttgattccagagtggttatctttcgtcaagggtgttgttgactctgaagatttaccattgaatttgtccagagaaatgttacaacaaaataagattatgaaggttattagaaagaatattgtcaagaaattgattgaagccttcaacgaaatcgctgaagactccgagcaatttgacaaattttactctgccttcgctaagaacattaagctgggtgtacatgaggacactcaaaacagagctgctttagctaagttgctacgttacaattctactaaatctgtcgatgaattgacttccttgactgattacgttactagaatgccagaacaccaaaagaacatctattacatcaccggtgaatctctaaaggcagtcgaaaagtctccattcttggacgccttgaaggctaagaactttgaagttttgttcttgaccgacccaattgatgaatacgctttcactcaattgaaggaattcgagggtaaaactttggttgacattactaaagatttcgaattggaagaaactgacgaagaaaaagctgaaagagagaaggagatcaaagaatacgaaccattgaccaaggccttgaaggatatcttgggtgaccaagtggagaaggttgttgtttcttacaaattgctagatgctccagctgccatcagaactggtcaattcggctggtctgctaacatggaaagaatcatgaaggctcaagccttgagagactcttccatgtcctcctacatgtcttccaagaagactttcgaaatttctccaaaatctccaattattaaggaattgaaaaagagagttgatgagggtggtgcacaagataagaccgtcaaagatttgactaacttattattcgagaccgctttgttgacttctggtttcagtttggaagaaccaacttcttttgcatcaagaataaatagattgatttctttaggtttgaacattgatgaggatgaagaaacagaaaccgctccagaagcttctaccgaagctccagttgaagaggttccagctgacaccgagatggaagaagttgattaatctcttttttcgccttcatgttttatatattatataaatttgtttacttatttttactatttgtaataatgattctgctttacgcgcctttaaaaaagttggtcttaatgtaaacatgaaccatagcacacaatttaagacatcagctgtcaaatgaccataaaattgtcctaccagctgtccttaaagtttagtgtacacttacgaatgacttatttactcacctttgcaactttgttcaataaattcattgatcttttcaagttcctgacatcttttgtaactggcatagagcttcagacttgaccagcctatagcagcagtaccacaacctataatattgaaaatcattctaaattccgaaggggagcaattcggcgtccattcaattttaaactttctctgtatccatagaaaagcattcaatagaagacctcctgtacatttaccaacaaagggccatagtatcttttctgcaagaatagcataccaattccgcctgataaaaaattcctcagctggaacgctattactagagttttcaaaatttccgtgatacaaatacttacctcctttattgatcagcctcctgtaaattaagtcaaccaatcttttaaaggtaaaattatagcaaaatgtagccaagttagaatacaaaattattttaggtaaacctatacccttgtaatatttgtttccagcagtttttacaatactgagatacacccacttaaagagtattgcattagcactgacgttagaaatgttgctaagataatgtatgaacccatatattatgatcgaggaggttaaaggaatgcttaataagccacgttcagtttgcgcatatacgtccaatgcctttgtagtgctgatgtttaacatatttcgtagaacattctcagggaaaaggcagcgtagttgccataatccaatgtcaaaacttgtcttttcagggtttaaaagaaataaactagttatccctaatggtatcacgtatcgtgtaattttttgccactgataaaacagggatagtacagaagactggatggttactgtaggtctttttatgaaatttgttttcttgcattgaggacattcgccaaatttcactaacacataaggtggatgattatcccgtttggtataaagagacattagattgaacacgtagtcattttgaaacggtactgatttttgcccccaaatgggacgagtttcccatatttctgtaagagagaaagtcgtcataaaatcatggtgcccatcaacgagacattttaaacaggtgattataggtaaatcagcatcctttggtaggtccactgtgttcggaagaaaaagttcaacatgcatttgatagagccatcttatatagcagcgtttatgaatttgtaagttgcaaccgcacgtgtgctgtagccatgtagagtcatatgtggattcttccaaacatatccagcatatgcatcttttttttatgagagataaaaaaaaatgaggtggggtcatataaaacttggactatttccttggaattttcttgtttgtaaaatcagagcagagctcttttatttacttttgtttttgacgatggggacgagcgatgtactcacatcttcgatatcacttgcctgaaaatatataaatgcgttaaacgatagaaaatcaaaaacatcgttcttttcactagaatattttaaagtcaaaacataacactttactatttacgtaacgaagtcttgtagttgtatatatttacagagtgtagtgctttagttgagaaaatatgacactcggctttcctctttcttttatttactggcttggttgttgcatatccatcatgacgtgctttcttaacaaattttttttgatgttttttttcaaggtcaaaggatcctcaacaccatgatccttcaaaaattgatcacattttagatcattcgacaacaattcggataatcgcgtttgaatacgatcaatgagacttctttgtttctccaaattaacctccaatccagagatgtctaactgtaaaagttgcctcactgtttcttgtgaaaaatcttgaatgccgtacctttgtttaatctccaataactctttcggcgttgacccgctagataaagcatcttggatggtcctaatatcacgtaaaagggttgttttttcatttagtttattctccctcactgatcttttatccaaaaattcttttgccttttgggcttcttcttttgcaacgcttaactgagcttctgattcgtataatgcaaattgttgacccttgtttctaataatttctgcaatggcaaaaaacttcctctttgaaagcggcctcgtcgcttctatccttactaaatcaccctcccttgatatttcaccttcatcatgcactaaataatctcttctatgaaataactccttgttgattttcttattaaagacttttgtttctacacgtactttaaccgtcttttgcatcttcccttgggagacgaccaagcctaaaaaattttggcgagccattacagtttaactgatcttgatttgacttttgaaatctctaacccgaattcaactccctgagtttacttctgtttggccttatttgtggatttcctctaacagtttgatgctcgcattggtttggcacaatcccaaattgcttcagaattctaatcttatgaaataacaatcatgttacccggttgaatcgttacccgacatctctgactcttcttgaggtatagactcctccttttcggagtcatgactctcagaggagtcatcgaagtcagcattgagctgtgaaggaccttgataagctagtcgaaagatctccaacgaatataaatggatgtatatatagcaggctcgagtggcacaattttcttctcttcaagttccagtgaattagtctttctcgtgtgtaccaatcttactgtattgattgctgcgcgatctaaccatcaactaaccacagtttattggaaaaacgtttcctaataccaggaagataacatgcttaggacaagagtgactgctctcctttgtagggctactgtcaggtcaagcaccaattatgtttcattagcgaggactagatcattccattctcaatctattttgctcaaaacagccgctacagacataacgtctacacagtacagcaggattttcaatcctgacttgaaaaacattgatagaccgctagatacttttgctagacgtcatttaggtccttctcctagcgacgttaagaaaatgttaaaaacaatgggttatagcgatttaaacgcatttatagaagagctcgttcctcccaatattttgaagagaagacccttgaaactagaagctcctagtaagggattctgtgaacaagaaatgcttcaacatctagaaaagattgccaataagaaccactataaagttaaaaatttcataggtaagggttactacggtacgattttaccaccggttatacaaagaaacctgctagaaagtccagaatggtatacttcttatacgccctatcaacccgaaatttctcaaggtaggctagaagcgctattaaactttcaaacggttgtttcagatttgactggtttgcctgtggcgaacgcctcattgttggatgagggtacagcggctggagaagctatgctcttgtcattcaatatttccagaaaaaagaaactaaaatacgtaatagataaaaaattacaccagcaaacaaagagtgtccttcacaccagagccaagccgttcaatattgaaattattgaagttgactgttcggatatcaagaaagctgtggatgttttaaagaaccccgacgtatctggttgtttggttcaatatccagcgacagatggttcaatcttaccgcctgactcgatgaaacagttatctgatgcgttacactctcacaagtctttgctctctgtggcctcagatttaatggctttgacacttctaaaaccacctgctcattacggtgctgatatcgtcctgggttcctctcaacgatttggtgtcccaatgggttatggtggtcctcatgctgcttttttcgctgttattgataaattaaacagaaaaattccaggtagaattgtcggtatctctaaagaccgcttaggcaagacggccttgcggttggccctccaaacaagagaacaacatatcaagcgtgataaggcaacttcaaatatatgtaccgctcaagctttactggctaatgttgcttcgagctactgtgtttatcacggtcctaagggcctacagaatatttccaggaggatatttagcttaacatcaatattggcaaatgccatcgaaaatgacagttgccctcacgaactaattaataaaacatggtttgatactttgactataaagttaggtaatggcatatcctccgagcagttattggacaaggccttgaaagaatttaatatcaatttgtttgccgtggacaccaccactatttccttggctcttgatgaaacaactacaaaagctgatgttgaaaatctactaaaagtgtttgacattgaaaattcttcgcagtttctttctgaggactattctaacagtttcccaagggaatttcagcgtactgatgaaatattgaggaacgaagtctttcacatgcaccatagcgaaacagcaatgttgagatatttacataggttgcaatctcgtgatttatctcttgctaattctatgattcctttaggttcctgtactatgaaattgaacagtactgttgaaatgatgccaatcacttggccccaattttcgaatatccatccgttccagccatcaaaccaagtccaaggatacaaggaactaattacttcgttggagaaagatttatgcagcattacaggtttcgatggtatttctttacaaccaaattcaggtgctcaaggtgaatatactggtctgagagtaatcagatcctacctggaaagcaaaggtgaaaatcatcgtaacgtgtgtttaatccctgtatccgctcatggtacaaatccggcttctgccgctatggcgggtttaaaagttgttcctgtcaactgtttgcaggatggctcattagatctggttgacttaaagaataaggctgaacaacattctaaagaactagccgccgtaatgatcacctatccttccacttacggtttatttgaaccaggcatccaacatgctattgatatcgtacattcttttggtggacaagtctatttggatggtgctaatatgaatgcgcaggttgggctaacttcacccggagatcttggtgcagatgtttgccacttgaatttacataagacattttccattcctcatggtggtggtggtccagctggagctcccatttgcgtcaaatctcatttaataccccatttacctaaacatgacgttgttgatatgatcactggaatcggcggtagcaaatccatcgattcggtctcctctgctccatatggtaatgctttagtgttaccaatttcttatgcctatatcaaaatgatgggtaatgagggattaccattttctagtgtgatagcaatgctaaattcaaattatatgatgacaagattaaaagatcattataaaattcttttcgtcaatgaaatgagcacactaaaacactgcgctcatgaatttatagttgatctaagagaatacaaagctaaaggtgttgaagctatcgatgttgccaagagattgcaagactacggattccatgccccaacgttggccttccctgttcccggaactttgatgatagaaccaacagaatcggaaaacttggaagaattggatagattctgtgatgccatgatatccatcaaagaagaaataaatgccttagtagcaggtcaaccaaaaggacagattttgaaaaatgcccctcattcattggaagatcttattacttcctccaattgggatacgagaggttatacccgtgaagaagccgcttacccattaccctttttgagatacaataaattctggcctactgtcgctagactggatgacacttatggtgacatgaatttaatatgtacatgcccttctgtagaagaaattgcgaacgaaactgaatgagtacatacccattatgttgtatatgtatattagttgacgcatttatgcacatatgtagataatataaaatattcaggtcaaagaaaagttaaaagtttacgagagaaaattcgaagttgataactgagcaatgtgcacaccacaatatgtcgtggttgatttaaaattttatgattcgcctttttatttatatgctatgttattgtgtatgcaattagtataagaggtaaagaagctaaaaaagtgcccaaaaagaatgcttggcgaatggtgtcgtagttataagtaacactatttatttttctactcttcactttcttcctctgtagtgacctcggtaatttctaaaacctcgtctcccattagcagacttcttggacgacttactgatggaccttgtacctgatttgctgcttgtggtatttttgggtaattggctttgtctgatttgattgataatttgttcattttctttggcttcgtttaaattggcgccaaaaaacttagattttgttccagtactttgggcaatcccattgctggaagccgcggccctgttcacaaattcatcatttagtattgtgtcgtatttttcatgatcctcgcttgatctctttttgctaagatctgctatcgtggctttaaagtacttgaaccttcggcgatatttgtcctccactgtgcctaaagttgcaaaagccgaatcattcattggtaatattgctgccatcttttttaaaatactgtcaggcataaagttcccaactggaggaaccattctatttcctaaatttaaagataattccctcagacgttcgtatgtcattcgcagattattaagttcttgtgtcgagcgtaaatcgcttgtgtttttcaaagtgatcggatgtgagctacccatggtcgaaccgccgtatgtatacgatcttaggtgttccttcgcacttataaagcgcggtggattagcagccacatttcctccaatggttgttgatttctgcgcgataactggtatattatcttcatttgcttgaaagctagaagatgtcgagggacgggagtttggtgctgatattgtaaattgcatctttatctccatttttccagtcagcaatttcttagcattgggaccaactttcacatagcttgaagcaaaaccgctattgttcattattgaatactcttgtaaaactcggatcgtaatcaaatggaagaaaatcctttcgatttctgatttttgcatggatttaccaataccatgctcctctaaggtgtcatggttagcctgaacaattttggagcttctcgaacctttaaagacatcttggcaataaattattgtgactctttcattttggatactttccactaattttacaatcttcttggcaggttctgtaacatccctttcctcgtttatcacgttggcgctatttctacaattatcacagtttttatgacacagtttggagtcaaaatcctcattgaaataagataaaactaactttcttctgcagtcagtaacgttgtcacagtatgccattacttgctgtaatttattcagatgtttttccttattctctctgtctaagttcttatccttctggatcattgtctgcatggttctaatgtccctgaatgaaaagtaggtaatacaatatgaatagttcccatctcttccagcacggccggtttcttgataatagccttctaatgttcggggaacggtaaagtggtaaacaaatctcacatcaggtttatcaatacccattccgaaagcaacagtagcacaaatgacttgtatctcatccgcctgccatgccttctgtacacttaatctttcatcaggctccatgcctgcatggtaatatgcacacttgatgccatttctttgcatttgggctgatgtttgctcgcatgatttcttggagtggcaatatattatacccgtttgatttttgaacctagatttaaccgcatcacagatttcaaaaatggtatttttggtcttcttgtttacttcgtaatacaaatttgttctattaaaactttgttttaggaaaacaggttcctttagttctaaattgtgaatgatgtccattctgacttgttcacttgcagttgcagttaaagcaatcattggaatatcagggtattctcttttgaaaaattttaattctttataatcaggcctgaaatcgtggccccagttagaaacacaatgtgcttcatctacaacaatacgagccaacttaccgtctgcgtataatctactgatagctctcttgcattgttctgaggcactgatcatctcaggagatatgtaaactaaatccaataatccattaataaataaattgaaagtttgtcgtctttgctcggcagtacccctcgaactgaacatgctcgccttaatatttttattcaataaatgttccacttgatcttgcatcagggaaattagcggagagatgacaatagtagtaccatgtgttttacccgatttcaccactgcaggaagttgatagcaaagagatttaccaccccctgttggcataagaacaaaaacatccttaccttgcaaagttgcatttacagcctctagttggttaggtctaaaaccaggcagtttaaagacttcatgtaaacgatataaaacttcatcagaccaaggataggttggaccattcgtcttagaagataaattggatttactcactatatcacttaatgaaaaatcgtcatcaaaatcgtcttcctcatccttttgactaacactggatttctccctttttattttgggagaccaagatggtggtgggtgttcattgtcacctgtaagcttcctttctgttattattttcaggtcattgtctagttcctggatatctgctacttgggttctattctctctttcttcgtcaaatctttctaaatcgctatctgataggtactcgataccgttattgttattatcttcttcaaaatcctcattttctttttcgctgtctatcaactctagatcagaatgagacatgggcatgtgttgacggccaaaggagaaactcatgctatcatccaaaattgcgtccttttccagatcatcttccaacaagtcaatatgctccacgcctatttgattttggccatttgagggaacgctctgtgctgtgggagatgataaaataacttgaacatttttattttgcgacaaggtaattgtggacctagtgtcaccttcttgagaactttcctgaatatttgcactaacatccatattatcatgataatctgtgtcttgagttgggtctaggtcgtcgtttaccacaaaatcaaaatcgctttgatttagtaattcgttttcttctttttcttcatctctagtagtcatgtagctggaatgggcatcatcttctgcctccattgttaactcatcttcttctctttcgacatccggataatcgtccctcaaagatttacccataacatagtcaaaaggatcatccctatcaggtattctgtagttgactggttctcttgaacgcatatttctccttcttgtaagttcatcttgttcttctgacgtcatgtggagatgcgggaatgcgggagaatgtggagccccctccttcaatattacaggagggtcacagtctatatcatcctcatcatccaggacttgaatcaaatcatcgttattactatcattattgctattcttaccggtgttattagtaatattttgcttcgcaccagtgatggctaatgccttagtgacggtagtcgcagtagtacttgtcaggtttgaattcctggaagatgtattgtattccaaggggctgggcagaatgcttgatatgatattatcatcttgtgaagaaacttgactgcgacctttactttgatcttttgacattccatcttttttggcttttatgatctccttttccagactatctattcgtatcgacatatttgataactgaggccgtatatccctacttaactgtagccttttagcgtcctctgacaatgatgtggattcgataatactacacttctgtagcaataatttcgattgctctttcaatgccataattagggagccttgaaggcggatcacctctaattttatatcattttcgagctgtttgcctatacttgaattatcgattacgcttttattgttatttctactacctagatttctgctactgtcattttcgacaagagaactagccatgtgcggtcgaaaagtattgaaattgtgagttttcgagccattgggcgtcctcgggttcgatacaacacttgtgctggctggtatatcaaccatgggtacgtcnnnnnnnnnnnnnnnnnnnnnnnnnnnnnnnnnnnnnnnatattgattcgatgtggcagtgtacgagagccattctgtatcgttcgacaaagtttgcatgacttcatgttgtttcgtagcagtattcgttggtccagatgcaggaatgctggttataaagtttgttgttcctggtccacattcatctttggatggcgttgttggtggcgaatttgtcttaggccttttgttcgcgatgtgcttttggatagcctggaatacgaaatctttgtcttcctgtaaagtcgccgtttcctttaaccatttgtgctcccttcttaagttatgtgacggcttcgtcaccattaccgccttgtgtgtacgtgtatgattttttaaatatatacaacaataatctgtattttttcctttcctctagccaatgactccaagctggctgataaaaacaaactaaacggtaaagccacaaatccgaaatgtatcaccaatgatcacccagcctgctaagtgccctctattgatccgtatatcagcttttagatcaggctcgagtttcttgttatatgtgcattgcaaaagcataaacaaatcctggcagccgaagccgggcaatccacttcgaaacgcacggctgaactatataaatataaaggacatgtggagagaagcttctcttccttcacatttcgcatttcatgatctaaagtggttctttcacaatagaagagcaccaacacgaaatatggctgtcggtggtaataactggagcatgtggctgcgaatgtcacgggtccacctcaggcagatcacgaagtctctggaccgaacgctgatcagtttgagccatgggaatttttcccaccaatataatcgcaatatttttgtcacttggtggaagagcctatttgaggcttctacagcttttaggagggcaagtggtttaacggtatctcctctcacgaggagaggaatcgcaaggtttgaccatttcagacctgttcccaatgtcagtaaatttgcttcttttcccagagtgcccaaaggagccccaaggggcctttttaccaactggaatatgactacatcaaagagattattagggcagagagcttattcgacttccagtatcaaatttacccaagaagccgtgaataacatgactatatctttgaggtgttttttcaactcactaggcggattaaatcagtgctcccactctaattcctgcaaagcttatcagaatgcgtctaatgttacctctaaacaggatcacgtccaaccagttgcccttaagaagttatctcaaaaggatatcaatttcattcgtaatttagaactatttaagataatgaagacccagaatgaagtcgttgatgaaacaagcgcatattacatggaaaaaccaggttcctatattgaatttaccatttcagaatttaacgttaatgggacattctccgcacctttgtcatttttagatccttctttgttagcggatttggatgaaatgattagaaattacaaatacgaattaaaatcaatatacagtagtgttgacatgatcttgcagaattatggatcattgccgataacttttcatcgaaataagattcgaatacattttccaaactcaactgtggtggaaacagaaaaactaattgcaggtctgaatattgctacgggtgttatttacgcagatacgtctcccgatatcagtctagaaggtacaaatttgaatgctctggttaatgttgacaattcaggaagcgtatggtcttttgttaaggagccctcgtttccctctaggagcgctttttcacctattttatcagatgcatcctatgatacttatgaattggtctagcaaagacgttgtttcatcgcgctattaccaagaaggttactttacttgttcttgcacatggacgcacgttgtgtgttcatatatatatatatatnnnnnnnnnnnnnnnnnnnnnnnnnnnnnnnnnnnnnnnnnnctatatatatatttgtgcttgttttcattgtctctatagttaatacattctatttttatcgttatatttgcattctcttcgcataaaaacttcatgaaaattcggcagaaaataagccatatatgtactttatccataggcaaagaaaagcacttaacgagaatatacaacaattgcactagtactgcatgtatatactcttatgattatagcggcaagaaaacaaatataaacacactaacagatgaattcgaatgaagatatacatgaagaacgcattgaagttccacgaactccccatcaaacccagccagagaaagactctgatcgcatcgctctcagggatgaaatatcagtaccagaaggcgatgaaaaagcatattcggatgagaaagtagaaatggcaaccacaaatgcatccagtaactttggctcaaatgaaagtgcaaaagacggcgaatcaatcggcgccttttcaaatccccatgaggctctgatgcagtcaaaattgagagaagaatcccagagtaaaaccatactaccatccgatgacctcagccagcaattagaaaccgaagaatccaaagttgaagaggctctaaaaagaataacctcacccccattaccaccgagggctgactgcatagaagaatctgcatctgctcttaaatcctcattgcctccagtgctagcaggaaataaaaatgatcaagccccccttgaccgaccacagttacctccgaggcaggtagttaatgcggaaactcttcatttgaaggcgccccatggtaatgcgactccctccaaatcaccaacgagtgctgtaggtaattcttcttcatcgacccctccaaccttaccaccacgccgtatagaagatcctttagacttggctgctcaaaaacatttcctagcgagtacatttaagagaaatatgctcttttataaaagtgaagataactctatcaaatgtgatttggataaaaatatactaaatttaaaagaagattcaaaaaaaattaacaacaatgaaattcctgaagaggttagttcattttggttaaaggttatcggcgactatcaaaatatcttaataaacgatatcgaaaccttacatttccaactatctcgaggtataccagccgcttatcgattggtagtctggcagttagtaagttatgcaaaatcgaaatcctttgaccctatatatgaaacgtatctaacggaaatggcaccttttgacgtccaggaatttgaaaatcagctaaaaatgatggacgaagttccctctgaatacgtaaaacgcataagtaatgtgttaaaggcttatttactttttgacccagagtgtgagttttctaccgacattgcttatattatcaatatgattcttgacgtttgcgaggaggaggcaaatgcatttggtctacttgtacgcctaatgaaagtttacggtttaagactcttgttcttaccaagtgcttctgagatcgatattctttgctataaatttgatagacttgtagaagaattttatcctgaaattcacaaccacatggttgaaaaaggcgtccgttcttccatgtttttgcccggtttcttcacgacactgtttcaaaagaaacttcccactgaaattcaaccacgtatcggtgatatggtatttttagaaggtattgactctattatgagaattttagccacacttttatctaattcccgagaccatctgttaaaaatgggttttgatgatatgctggagctattgaaatcaggtctgttagatgcttatattaagcagaatgatggtacacgcggtgacactcttctctcaaatgaatgtatggataaattactacaagactctatgatgaaagtagcaataaccccaaagactatgaagaaatattcttctgaatatgaggaaattcacagattggacaatgaaaaagaagtgcaatataagtctatcacggaaaaaaatttacatttacaaaagcatgttcgtaaattagaaaacgactacacatctttaaatagagagcatgtgacaattgcgaacgagttagtgaaaaatcggcttaatatcgagtctgtattaaatgaaaataatggttacaaacttcaaattttagatttgaagaaaaagttggattcagaaaaaaagaagcaagttttaggtgtatatgtgcccaatgatttaaagaaagatttggaagagacaatgaaaaagaatacccaagtaatggacgaaaatttgaaattgcaggataggatttcagaactagaaaggcttattgaagaaataaaaactgcaaacaaaaatggtacgttattcgaatattctaattctaaaaataatcctttgggagccggctggtcaggatttaaaaaggtttttaaatagttaaactgtgtatatcagctactgctccccttgaatgatacatgactaaatataatgataaatttatttcttgatttttgattatttcatattttgttgacatttgagagcttcaattgtataaagttgcaagataatatatgaggttagggaagccggataaagaaaatagagtactttaaaactgttcatggactaagaattcagtgacgatgaagtagtaaaggagagtgtttaggatataaataagaccgagaaattgttagtaagcattacttctagcagaaataatgaaccacaatcgtgacaatatatactcgagttagcagttaacagtaaccctttccataccattctaaactttgcaacagtaaatatcttggcgtttaacgttttattttattctacgtttctcaaatatcggctgtactcatgtggcacatcatgaaaagagccttcatatcaagaattcaagaattttaattacatcgtgacaacggtttcctaaacttttagtaaaaacaattaaatgtgcaattttgttgattatactgtggacaaattgagcttagtacgtttccttcttctctttctgcaattatatttaattaaataatctcgtattctcgcatccgggcacgctttgtgaaattcatttgagaaaccaaaaacagctgatcagctagagctattagaagttagtgcccaggggtatagaaaaatcagtttaaggaagaaaaagctcacagaagaatatgcaaaaaattttcagaccattccaattaacgagaggctttacctcttccgtaaaaaacttcaggcaatggagactgattgaaacaaggaagattgccaaacaaccgaactaccaagttggtgatgctaaacctttacatatgccaaaagaaagaaagaaatttccagattacaagtatggggaatctaatatcttcaaacagagtaacaaaggtctatatggtggatctttcgttcagtttggtaacaatatttctgaaagtaaagccaaaacgaggaagaagtggttgccaaatgttgtcaaaaaaggtctctggagtgagactctgaacagaaaaatcagtatcaaaatgaccgctaaagttttaaaaacaatcagtaaagaaggagggattgacaactatttaacaaaggaaaaatctgcaagaataaaagaattagggccgaccggatggaagcttcgttatagggttttaaaaagaaaagatgaaatagagaatcccccacataaggatgcacctatcatagaaatggctggtggtaaaaaggccaaaatttactatgatgaaatagtaaacggctcaccaagaaaaatatcagttggaagaagaagattgatgtcatttttatatcctttagagaaattggaatataggtcagtagggaaggacctgaactacaaaaaatttgtcgagttatttgccgacgttccagtcaaggatatcctagctagattagaggatcataaattcgacttatccaccatcaccgtataaaaggaagaaataaagaagataattgccattccgaaaatatcgttggttttcccctgtatataaaaaagcatatctgtttgtacatatgtaggtatgcacacattctgaacattattgatgcgtatatgcttgctacattaattggcaattcattttttagactgttttacacccgtacatttcacagtttttttttgaagttaaattccaactgaatggaagcctccgctcctatgaaatttatttgaaatcagagatttcaggatgttgaacagtatagtactgatttacaagtatcaaagaaacaagaaagacagcaaacacaataagaaatgaccgttaagacaggtatgtgagacataaacaaggaactgaacgggttatgacgattttcgaacttataaaggggtttaccccaaatacgagaagaacatgagtgcattgaaaacttaaaaggaaacaaaaacaagaatattatataattttgagtgattaatgaccaatggaaatagccagaggaaaaataccatttaatatgcatacacaggcttatctcttcactcctatctaaaaaactattgtgtttgaagatgaggtccattttacaaaaagaatagtattgcgaaaacgccttcaaatggaacattttagtagttgcaccattgtaagaattgccatggaaaacaatcacaaaaagatgctatacaaagccgtacattatacgtcacttcccgccgacacatatacacgtgtatatgtatgcctatttcacatgttactaactgaagacaacctgtgtccttatatttaggaattgctattggtttaaacaaaggtaagaaggtcactagcatgaccccagctccaaaaatctcttacaagaaaggtgctgcttccaacagaaccaagttcgtaagatctttggtcagagaaatcgctggtttgtctccatacgaaagaagattgattgatctaataagaaactctggtgaaaagagagctagaaaggtcgccaagaagagattgggttctttcaccagagccaaggctaaggtcgaagaaatgaacaacatcattgctgcttctcgtcgtcactaagtttctaaaaactgatttttgtaatatatatatagatatcatattttctttttaacttaggaaaaaataacaccaaaaaaaaaaccaccaatactttcacacatgagagggcctagagtaaagtaccactagccatgcaaaaagcccatgtactgagctgatagtcgttaccaaccctacattttttttctgaagcaatataagtgttacccgaaaagtatgaatattattttttcttcgtaccgttatatctttttctggtatataaagcggtgagtttagaagaagttcctgtggtgcaagaatctttattggtatttaaaaaatcttttcttttcctttttttggttttttgaaaaagggtaataatgtcttttataatagacacccagagtcacgattcgtcttggttttagagattctgtttcgacagtttttttaggcggtggacgtatatagtttacttaatcgtttactatacggtggagtactaatactatttcactgtcgtgctcgcggttgatcttagataaatatatttctttttcataaagaaagtgagtggatcttccctggaagtacgaataatgtacttatgattagattctcttcacgcacatacctttttttttttttcaattgctagttcatacatacgtagaaagaagggccaattggaagcctcaactgtcccctggtgtaagctttcgctgtttcatcttcaactcaagaagcgaaggtagcggacagcagggtgaccgtgaatcttttccattgtcattgtaaaattttgagcagcagatgtacagctgatctataactttagcgcatttagcatcatcgtactgatgtgatagaaggcaatctaaaattaatgtgaaaaaacgttagtgaaaagaaaaaaacgatcgaatcttttgaagttaatattacaaaccttggatggcgcaggcctccttctggcatggattagacatatttacctcttatttgaacaaatctcaacaactaaaaaaacgctcaatatcttggaaaaaaagaacagtaatattctgtctctccacaccctcttctgaactctcatatacaccccatgggtgaaaagtaatatccgtaaaagtctcgctaacggatgacgttaacaacgcacgcccgctccttgcgaaatttattgtggggacgtcgttcacgtgcaaaagtcgccaaatattagcgacgggcaacatcggaaaaactctgcgcccgcgattccgattgagatgtgtaatttgtagtattgaacgtgacaggaaacaaaaaatatcaaaacgctagcaaggtttaaggggaggggtgaagaacgaacgataggatactgcacaaatcagcaattaagaaacaatatacaaaaacccccaaagtggtcatgttaaggagggcatttttccgcatggaaacgaaacgtgggcatgacgtggaagcgatgatccgagcgcttctgctactgtggtgaccaccgtaccaaaggaggggtaataagaccctgtgccctttgccagcatacgtgttacccccctcaaaaagagctggctgttcgagctagctgctctttctgttgccattcccgtaccaagagcgccccgtagctcgattttcagcaccttggtggatatcaggggaattttaccgccgcaagcgatcagcgtagagtgcgcacagaaaacagacagaaatgactgaagcggatgaaaaaaaattttctggcgcggcccaatctccgcggaagagtcattccgtgaaatgaaaacaaaagacgcgcatagtaggagaaagattatgcagcttgatagcgggttatcataccagcgttaatgacaccttcaagtgggtaaagtaccctttgttatcgttttcttggctacgcggatagactaatttaattgatatatatgtagctagacacgttcataatttttatgctctagtgcatgtgcctcttactcattattgtcaaaaatttttgcatgtaatatttgttttccgtagtcattcagcactagcctgtttgttaatatatatagatagacaaactaatgacaaggagaattgaatttctcatataacacatacaataaaaccaagaaatgtcttcaaactatgccactcctttagacgatgaggtgtttcccttatcttttgccaattatcaatttaccgagcatgtgtcacttggtgagcattattcactcaatacttcggaagatgccaaatataataatttgaatggtcctttcgtggtaccgagagacaccgggaagttcgatttgaacacaagttctgcctcggacgagactgtgttctcgttagataaccctcaagaaaacaactacaaacaccaagccatgaataacgtccaggattgtcgcatggccgtcgcggccaaaactacccagtcgtgtgataaattgaccgatctttatgccaatgccgcccaacaaaactacagattgtggctgtcttcattttagaataacgattaaggaatgataatcaaaagaaaaaaacaatctacctacatatatatgcactcaacatacataaatacacacgcattattgtttctataaacttccaacagacaatattcccatacaaacatcaactaactgatttcctcttcatacgcgttcgcttcacgtgatgttccttttccattgaaaggagagctcatcacaagagttacaatgggagtggcggcgcaccgtctgctgacaagaataagtgtaagaccagctaccggaagaaaaaagaaaataaaatggatactctgtgtctccgaatgcccctatttgttgtatccattgattgttatcctgtcttcttctttctttagtttaaatctttagcgattcagatccaattgaacaaaaaaaaggctagatcaaaaataaggggtaaaacatcatcttgcggggctaacccagatcaaaagcggcaagccaagaaaacctgtttgataacactgtaatatatatatatatatatactatacgatcgtaccttggtatccaccgctttctcagcacctccaaatttctaaagtgcaactaaagagtcttgtcaagtattcttttactagtgttaagaccttgtattggtaagagatagcaagtctaaacagcaacaatgaacaagctaagagacaaatttgtagattctacagtagaagaagaaagattgcgtgaaaatcgaaatcatgagaaatactggtatcgttggggtccctacttgagtgaaagaagctgggcgacagtccgtgaagattattctttaaacggtgatgcttggagcaattttcctttcgaacatgccaatgcaagagtattccgttggggtgaagatggattatttggtgtctcagataacaaacaattggtgtgtatgaatgtcgctctgtggaacggtaaagatgaaagattgaaggaaaggttgttcgggttgactgggccacaagggaaccatggtgaggatgttaaggaattgtacttttacctggacaatactcccactcattcatatatgaaagctttatacaagtatccctttaaaaaggcctttccatacaaagaattggtgcaaaagaatggtgaaaggggatacgaggataaagaattcgaagtttacgatatagatgggctataccgtgatagtgaaaccggtgacaacccttatttcgatgttttttttgaaatggcaaaggatgacgaaaaccctagtgaactgaactttcggctaactatacataatcgaagtaaaatcgactctggtgagctctacatagctccccaacttttcttcagaaatacttgggcttttgacggtactagaacaaaggacaagcccttgcttgaaagagatgcagaagcagcgaacttaatcaatatgactcacaagaaatatggtaattgccaaatggtctttcagccatctccaggtgggttctcttccggtacaaacgaggaagaggaagataaagaggtagaagatatagatcctctgctgctatttaccgataatgagtccaatttagtaaaactatttaacgaagaaaagaatccttccgagtacacaaaggatgcttttgaagaatatcttgttcaaggcaaaaccgatgctgtaaatcctgaaaataaaggaacaaaggcctgcgcagtatatcacttcaaaaatattccgcccggagagtatgttactgtgagatacaaatttacaaatgacccaaaaaactctatctttaaggcacaaaacctggctgtcgtagatgaagatgagtttgatttgattttcgataacagagaggaggaagctgataacttctactggaggattacacctttgccaatcagtgatgaattaagaaaccttcaaagacaagctttttctggtttgctatggactaaacagttctacaattttacatatgatgcttggtataatggtgacgccaatgttaagcctcgccctccccctaatagagctaatggcaggaacaagaactggaagcacctttacatcgaagatatcttatcaatgcccgacaaatgggagtatccattttttgcttcatgggatactgcgtttcactgcattcctttagctatgattgatccagaatttgcaaaacggcaattggatttattaaccagagagtggtacatgcatcctaacggtcaaattccggcatacgaatggaacttcaatgacgtaaatccaccagtccatgcatgggctgtgtatcgtgttttcaagatcgaaagaaacatgtacaaccgtgaagatcgtacatttttagaacgagttttccagaagcttttgttaaattttacatggtgggtcaacagaaaggatactgaaggtaaaaatgtttttgagggcggatttttgggtcttgataatattggcgttttcaacagatcagaaccactacccactggcggtacgcttgaacaggctgattctacaggttggatggcctttttcagccttcaaatgctaaatattgcattagagctcgccaaagaaaacccggtttatgaagatattgcctctaaattttttgaacattttatcttaatcagtgactctatgtcctttgaatacgctactgatattacgggagagaaatgtaaagaagttatcaaacaaaacctatggaatgaagcagacaaattttattacgatgccatctcttggggtgaccacaaggtgcaactaccaataagatctctcgtgggattgatcccactatatgcttctatgactttagagcctagtatcataaaacaattccgcggtttcaagaagagggttgattggtttgtgaacaaccgtccagaaatctttgatagaaacattgcgtccatgtcaaaaaaaggagtgggagaaagactacttttatccctagttactaaggaaagattaacagccatactgtcacgtttgctggatgaaactgagtttttgtcaccatatggtattagatctctttccaaatatcatgagaagcacccattcgaaatgaatgtaaatggtgtcgaatatatggtcaaatatttgccgggcgaatcagactcgggtatgttcggcggtaattctaactggagagggcccatttggtttcctaccagctttttaataatggaagcattacaaaggttttacctgtactacggttccgacttcaaagtagagtgtcccgtaggttcaggagattatttgaatcttgctgaagttgccgaagaacttggatatcgtatgattcacttatttgttccagacgaaaacggggagcgcgccattcattatggtgatcactctaagtttctgtcttctgatccatatttcagggattatgtgccattttttgaatactttgacggtgatactggaagagggcttggcgcttcacaccaatgtggttggactgctcttgtggccaaatggataagtgatgtaggtatatcctgtgtaagactacctcgtacgccaagatcatctgtggcaacgaccgcttcaacagagagctctgagcaaggtcccaaaatgaagagaatggcaagacgtaagagtgcaaagtctttggtaaactacactgccaccattttggacttaaccgaagaagaaaagcgccatcataggatagggggcacccattctgggttgacaccacaaagcagcatttcaagtgacaaggctagacatttgatggaggaaatgaatgaagaggaaggtattcacgaaactgtggtacctgaagatcgtcacaactttgaaaccaagcttataggcaagctaaaagataaggtgaaaaatatgaaagtaactgacaaggctaaagatgaggatatagacccaatggacccaatgagtccgttgaataaggatgtgtcttgattaactgcggtgaaccttcaatatctgtacgtttgaaaaatatttccaacgatatacctctatattttgatctatagaatatttaattgcagtagttttttatcagtaaggtagcgttgatattactagtgaaggtaactctatagttccttgacatgttctttagattctagaggttttttattgaatttgttttcccaccttatttaaactttgagaacaaaactagcaaaatcaataatataaggactgcgataatggcatagcttatgaatttattagcaactagccttctagtcattgtttttagtgtctttatacttttatccacatatgaatccgcttgaaacaaggtctgtcttgcattttccaaagtttctctctgtgaccttaaatccatcattatttgtgaccctattccttcagtttcatttgctattctactggcatcttttagtctatctcccgatttctgtaagattgcatggttgctcaacaactgttgcctttggtcatcgtcaatattagatgcgttaagatctccaaaaagtctatcacgatcgcctgagtctactaaggattgcagtggtcgtttgatatcgctctgtatagtcttcttccattctcttaacttcgccttgtacgtagcacgttctgaggcatcgcctatgctgttattaacttctacatccatctgatctagcaggtcaaacaactcatcttgttgctgttctacgtgcttcagtgtagtatttctctgtgataacggttgtgagggggcctctgctaagctcgctttggcttgttctaaggttgttttgaagtcagattcgtatgatattaatagggaactcatagtaagccatgcagcaatgtaaagagtgcggttgattcgttttatacaacttaatgtaaagctttacacttttccaagaatagtaattgccctatatagcacgactactccactcctaactttcattgaaaattagacagtcatgtgatcagtaatatcgtccatagtgatatttgtttgtttaccatttttgttcttatttactctctaatatgattctagtatatgaaagataccactgtcgtagctcgtatcaaaataaaactagtcagtcgttgaccattgagcatatcgtccgagaataaggctttactgtattattttttgatatccacacgttattgagctcattcactgatcgacacatttaggcggcttttccgtttggctgaagcaactttgaaacacaactacgacattataattaagcgcctaaataagtgaattttgtgccatagggttggaccgtgtatatataagagctattcactattttaatatttgttttggcatttgaaactcgttgacataagctttattattaggatgaataactccaaaattcctaaactttcctttcatagtgatccaaacaacgtcactcgagactttccaaagacaaaacgacagaaggttcagaaaagagaaatggatatgatactaactcctaataacaacaagctaaatatattgcacagctctggatctggtatacggcgctgctacactgatgacacctccgctacgtatactaagaaactaacctttgggggggaccccaagattattgaaagggttaagaacaatgaacgtaaggttagaaaagacatagattcactactgaatgctatttctgaaattgaaaaggaatctgttcgtattcatgccagggaactacctgcaataacattagaattagatgcaaaagtcaaagcgtgcagggagctacaaaatgagattgatggactatcaacggagatggacttgaaggataatcaatgtgatcttcaaagaaagaatgttgagctatcatcaaaaaatatagtgtctatgcatgcagtaaaagtacaagagttcgaaaacgatttagaggaagagctatcgaatgccaaaagggagtggacgtataaattaatggaagtagaaaatttgaaacctgacgaaaggttaactgacgaaatgcgacagcttaaaacagaattcgaggaggtcaataggaaactattcattctacagaatgaaaatgagaacgagtgtaaaaactacaaaaaagaattggacaagaaattcgagatattcaagaaagttaagaacgatgctagaattgaattagatggggagcaagaaagactttcgaaagttttaaaagacctacaagacacccatggtgaactgaaagaaaatattaagacgtgtagagatgagtttaacgattttgaaaaaaggattggagaggcagaagtgaacttccatagcatggaacttgccgttgttcctctcaaaaagaagcttgcttctacatcacaagcattgacgcaagtgcaggaggagaagaagcaagtcgaaggagaagcaaacaattggaagaagaagtacgttaatgaactagaaaaggttcaacaggaattatacacacgacaaaatctggccacttcaattgaagaaatcaaaggatacacccgatgctttgcgtatgccaatgaacgacaaatgcctgatgaattccatatcaactatgtggatcggtgcatttgcgagaatagtggagaaaaacgggtacaagtatttgatagagtagttctcgaagaaatccataaggatcacaaacgcttatataacgaatgcattccgttcctggaaaaatacatcagcaagttaattaactgcagcattatagtggtttcgcagcaacccacagcaccaatgaaaaagactttgctaaaacagttaattgagcagtacggtgagaattataagatgacattgaacattttgcatcttgacggaagtattaaacacagtgacgttggattagataacccaacagaaattagagatctgtcacaagatgaagaatgcatgaacattttaactttagataccaagttgggaaaagatgaagagtcccattcaatgaatatatatatcggtagtatgtccacggtacagctgaatagagagcttgatgatgctccctcagtcctttcgcatattctcactaaaacaaagcagtgctttgtcttcaagattaacgctggtgaaaacatcgagaaggctctagccttagcgggaaagctgaaaagaacaataacattacctcagctagattaagaaggccagatcttgtgcgctacaatcacttcgtctcgttcccttacataaaaaacttacgtagctacattgtcgtgcgtggcatcaacctaattatcctagcaaaataaaagagaatgttacgggactaacaggcggatgtaaatcactcacttaaacgcagccaaacatcatcgagaacttagggtagcgtgccacaaaatttgcatgaataaacttttgttttcctaattcaacagcattcccttgttcgcaacacttcactgataggaaatcgaatagcgcacactctcttctgggacataccccaatgcggtaaagccacgaaaacaccgcgggtaaaggggtaaacaagtccattcctacaacctcttggagaaattctttacctactacaaccccgcgcctgatactttcagtattcatgacaactcgagccagatcccgctcgtgggcgtgttcattctgtgacgatccactagcgacttctttgttcagcctgcaagagacgcgttcaaggaagaattcgcgattttacttcttcgagggaatctcgcaccgcgttagttagtttccaaccttgaaagcatcggagacgcatttttggcgattttgctggattgagctgaatggtgccaggtcgaggctgggagggagactaactcgaaagtgacgaagactcgaaaattaaaaaaaaagatactgcagaaggcaagattgagaatggagtaaaggcagcgtgggtcccctgtggaaaccgcagttttcctgcgccaagtggtaccggtgcgagtgcagcaattaatctctcgatattttcttagtatctctttttatataagaatatattttggaattggtaatgcttatcttcaatagtttcttagttgaatgcacacttaagagcaaattggccaaggagttcttcgttcgctttaatttatttcctggttattgtcaatttattcatcccatctccccaggatagaagaaattagtgtaattttgctgacaatacattttaacgacgataacaataatagcaattaaataaaatagcactaccaccactccactgctcgttagctatttctgtaaaataaataaaaagatcatgaaccactcagaagtgaaaactgggttaattgtcactgcaaagcagacatattacccaattgaattgtccaatgcagaactactaactcattacgaaaccatacaggaatatcacgaggaaatctctcaaaatgtgctggtccaatcttccaagacaaaaccagacataaaattgatcgatcagcaaccggagatgaatcctcatcaaactagagaagccatagtaacatttttgtatcaactttcagtgatgactagagtaagtaatggtatcttcttccacgctgtcaggttctacgatcgctattgctctaagagagtagtgttaaaggaccaagctaaactagttgtaggcacctgcctttggttagcggccaaaacttggggagggtgcaaccatattataaacaacgtctccatccccacaggtggtaggttttatggtcccaatcctagagctcgtattccacgcctttctgaattggttcattattgcggcgggtccgatttattcgatgaatcaatgttcattcaaatggaaagacatatcttggatactctgaactgggacgtttatgagcccatgattaatgactacattttaaacgttgacgaaaattgtttgatacaatatgaactttacaaaaaccagttacaaaataacaatagcaacggcaaagaatggtcctgtaagagaaagtcacaatcttctgacgacagtgatgccacagtggaagaacatatcagtagttcaccgcaaagtactggactagatggcgatacaactaccatggatgaagatgaagaactaaattccaaaattaaattgataaatttgaaaagattcttaattgatctgagctgttggcaatacaacttgcttaaattcgaattatacgaaatatgcaatggtatgttttctataataaacaaattcactaatcaagatcaaggcccttttctctctatgcccattggtaatgatataaactcaaacactcaaacgcaggtattcagcattatcatcaatggcatagtcaattctcccccatctttagtcgaagtttataaggagcaatatggtatagtacctttcatattacaagtaaaagattataacttggaattacaaaagaaactgcaactggcctctacaatagacctaaccagaaaaattgctgtcaattctcgttactttgaccaaaatgcctcttcatcatcagtttcttctccaagcacatattcttcgggaaccaattatactccaatgcgaaacttcagtgcacaatcagacaacagtgttttcagtactaccaacattgaccattcatcgccgatcacccctcacatgtacacttttaatcagtttaaaaacgaaagtgcttgtgacagtgccataagcgtaagcagtctacctaatcaaacccaaaatggcaacatgccattatcaagcaattatcagaatatgatgctagacgaaaggaataaagagaatagaattcccaactcatcatccgctgaaataccacaacgtgccaaatttatgacgactggtatattccagaacacaggagaacttactaatagagcgtcttcgatatcgctatcgttaaggaaccacaatagctctcaactgtgaccattttctcatcaagcctacatatatacttaattaataacggaatactacgcttttccatcgtaagtaataatgacattcatacttgacattttaataccagataattttaatgcccacctacaaacatctagcctcaatattcttcacctgaaaccagctgaatagtaatataccaatattctttcaacgattgatataattatcatcatgaacggaaaagatgacgcgatcttccagtatttttttcttcctttcgttctaacgtttgcggtaagcaaaggagagtagtaattagcaaacagttataaatagaaagcctctctaagattatagatatatagtcatactaaagcttgagatctcatctttttcgagaacctaccggcatattaaactgaagtaagacatcattctgaggaaaggatcggtattataaccattattatttgttgcgctttattactatgtggtcgaaaaagtttacattaaaaaagctaatcttaggcgggtatttgtttgctcagaaagtctattgtgaagacgaaagtaactctatatacggtacctggtcatctaaatcaaatcaagtgttcacgggaccggggttttatgatcccgtagatgaactattgatagaaccttcattgcccgggcttagctattcgttcactgaagatggttggtacgaagaagctacttaccaggtaagtggcaatcctcgtaacccaacttgccccatggcttcgttgatttatcagcatggtacatataacatttcagaaaacggtacgttagttctgaatcctattgaagttgacggtagacaactattcagcgacccatgcaatgatgacggagtttcgacttattctagatataaccaaacagaaactttcaaggaatatgccgtaggtatagatccttaccatggtatttacaccctgcaattgtaccaatatgatggtactccaatgcaaccactatatttggcttatagaccaccaatgatgcttccaacagaaactttgaacccaacatcgtcagcgaccagcactgacgacccatcctctaataagaaaagatcactgagaagtttagtgaggaggagcctggaaaacagacacaagacgaatgccattaaaagacaaaatacctcatttttaacctccaatgccatttggtatatttctgcgggtatgctaggtgtaggttcattattatttttagcattttaggcgcactacagggatacttattcaaccaatgggggaaagaggccccatgtggccttcaaataaatattaaaaactataaacatataaggcaaaacaactttatcaggcgagaaagagaagcaagaataggtgtaattttatgcacccaaggaattgattgtaatcatattattaaataaggtggatgaataaaagattttcaaaacagtttttccgagatagttaattatgtacgagtgacaaatgggatatcaatcaatgaacacaatcaaaacaccttattatgactttcttgttatattcttatatacataaccaacatttaaatgtcaatttcttcagtttctagcccgcagtctgtacatcttcttctttgaatttgataaccgtcttcatcaatacctccatcaactggatcactaaaatgatgaatatgggctttcccatgcttcttttcccttaatctattagtatattcttgagctcttgttttcagtcgcatttccttgattttcttttcgtattttttctcccttctgtgagcctttccttcttcacgacgttgccattcctcatctaaaccttcttccccaccccatttcttgaacgcaaaggcttccacttcacatctaacaaatagttgcattcttgcaaatgtccccgaatgagggttcggcttttctagtctatgaaagagatcctcatcattcaattcggggtctgttaaaaagtaatcttccttacattctgttttcgtcagtagtgcatacttttctggatgctccttagaacactgtttacaaacttgtaacttgaacacatcatgtagcacaggatccatctcaatattaatatgacattcaatacatttcggcgcctttgaaatatgctctggaggaggtgcattttcgtacagcattttccgttcaagttgttcctttttccagtcctgtagtgtcttctgctttttagatccaaactcagattcaaattcttggtcatcggtaaagtcagaatttggaagcttgtccttagggttgatataaccaccattcaagttctgcatggtggcaaaatcgtactcaatgtaatcttgtttccttatgctaggtctgattctatccgttggccttttgtcgagtaccgacgcatcccttttacttccatcaactactccgctaccataaagtgaagtagtgttagtgttagtgttagcaagcgcagacggttgtccattatgatttggcacatgtactgcggctgctgcattatcatcccgattgctgccactagtaactgcgagaggccgggtttttaaaggttcattcctactttctattcgattcaattggtcgctactcagtattcccctttttcttaaccgttctattgctaatttcctgttagcctcctgcacagctcatctcatcgttaaattgttagtaaaaagaaacccacggttaaaatacaaacacagaatcattttcacacatactagtttggccttttgttcgggagtcatagcgttacgttcgataccttcactacgaagatccaaactctttttctagttccgataaattccttaccttcttttcactttcctcttttctccctacaacttagcaaacgtcaaacatgctgtagatagagcttctatagaagtacagttattcaaacaaaaaaaaaaaaaacaagggttgtggagtatgccactagcagtctgctatgttgattctgcttattatcaacgaagtatcccattatgatcttatgcaatgcacattcctgcccttacgctccagggcagaatcgaaccacggccctcgtataagccgcaaggaaaactaccggtgctatcgttctcgtttggatgattttcagtatggaagaatttggatagatctgcagcgccatggtatataagagaaagaagcggtaacgtttgacactgggttcagatctctcttgtcgctcaatcaaactaagactagcccagaccattatagccatgaagtttttcccactccttttgttgattggtgttgtaggctacattatgaacgtattgttcactacctggttgccaaccaattacatgttcgatccaaaaactttgaacgaaatatgtaactcggtgattagcaaacacaacgcagcagaaggtttatccactgaagacctgttacaggatgtcagagacgcacttgcctctcattacggggacgaatacatcaacaagtacgtcaaagaagaatgggtcttcaacaatgctggtggtgcgatgggccaaatgatcatcctacacgcttccgtatccgagtacttaattctattcggaaccgctgttggtactgaagggcacacaggtgttcactttgctgacgactattttaccatcttacatggtacgcaaatcgcagcattgccatatgccactgaagccgaagtttacactcctggtatgactcatcacttgaagaagggatacgccaagcaatacagcatgccaggtggttcctttgcccttgaattggctcaaggctggattccatgtatgttgccattcgggtttttggacactttctccagtactcttgatttatacactctatatagaactgtctacctgactgccagggacatgggtaagaacttgttgcaaaacaaaaagttctaagctgcccgacctcacgaaatcagtcatgcggtagtccattataatataactattattattattactattactattattattattattattattatctattgtttatattctctttagctttttatcacctacgacgacggatatattcggcgtttgcaaaaagtgaaaaaggcgtcttttggtggacatgaactcaatcttcaattctttgaaagcggtgtatgcgtataaggccttttaaccatcgtgcaaaacaataaaagactaccaataaccgacgtgaatcatgtctgcaccaactccattagcagaggcctctcaaattcccactatcccggccctttctcctttgactgcgaagcaatccaaggggaatttcttctcctcaaacccaatatctagctttgttgtggatacgtacaaacaattgcattctcacagacaatctttggagctggtcaatcccggtaccgtggaaaacctgaataaggaagtctcccgtgacgtgtttttgtctcagtattttttcaccgggctaagagctgatttgaataaggcattttccatgaatcctgcttttcaaacctcacacactttctctataggttcccaagcattgcctaagtacgcattctccgcattgtttgccaacgataacctatttgctcaaggtaatatcgacaacgatttatctgtttccggtagattaaactatggttgggataagaaaaacatttctaaggtcaacctacagatatcagatggccaaccaacaatgtgtcagttagaacaagactatcaggcttccgatttttctgtgaacgtaaagacattgaacccttcgttctctgagaagggcgaattcacaggtgttgctgttgcatcttttctacaaagtgttactcctcaattagctttaggtttagaaactttatactccagaactgacggtagcgctccaggtgatgctggtgtttcatacttgactcgctatgtctccaagaagcaagattggattttttcgggccaattgcaagccaacggtgctttaattgcatcgctatggagaaaagtagcacaaaatgtcgaggcaggtatcgaaactacattacaagctggtatggttcctattactgatccattgatgggcactccaattggtattcaacctactgtcgagggttctaccactattggtgctaagtatgaatacagacaatctgtatatcgtggtacattagattccaatggtaaggttgcatgttttctagaaagaaaagttctgccaactctgtccgttttattttgcggtgaaatcgatcatttcaagaacgataccaagattggttgcggtctacaatttgaaactgctggtaatcaagaattactaatgttacaacaaggtttagacgcagatggtaacccattgcaagctcttcctcaattgtgaaaatcttcccttggcttttttatggttgaataaataatcattgtttttatctttcctatgctttttttttattaatttgtgtaacgacttctccctccagcatacgctcccagacttttttgtttttgttttaatataaataattatgtatatacgtgggcaccaagttgagggggaattccttgtttatagttatgatacgtctcatatccttgtccttactttcacaatggtctaaaataaaagacaagaaaacaaaactgcaaatatattaaattctatttttcttttttagaagaagctattaataatagatcaaatgttccagccatttatattcacattgtatactccttcactttggtttacacctacattcatttgtgcagttatgctttgaacttcattcaaaggtcgccaagaccagatatggatctcctctgaaatcttctatgcctgtcctgcagatacgggggagagtcgataaaagggtatgaactatatcttttgttttgctgtttcgaatgaatacttggggctgctattggaatattcagtacaggagcggttcgtctgatagcatttttgaaagcttcatttatggagattgacacggcatcggtagggtcgctcggatagagaaagcttgcatttagattagagcaagtgttcgatatcacggagaagctattatctgtacatccttgttcgtattcttcatccagcaagtaattaaggtcgtcatcatcataattatcatcatcatcatcgttatcatcatcattattaattatttcagtattggggggctctatgtccgaagtaggcggcagtttgaatttatcgctcaaagactcattattcccaatagtagctccttcattaatatgcgaaaattggcaaattttgctaatgacgttttcaaaagctttcacactattttccaactctgattgggattgactaatcaaaggtagaaattcgatttcccagtaccgttccggattataaaagctaataaagtatttgaaacctgcgccatttagccttgttatttgtagtttgggtagtactggatgcacaatatcaccatgtcgtcctatcgataaatagtttactacatgcccatcatgactactagctttactagatttttgaaagggcgctatattttcctttaacttatcaaaccctgtacatatctgatatatttcaataggtccttttgccattaaagatgtaggttttaacttaatagtgttttgactgtcttgactttgcgtatcattgaagaatactccactactttcagtgacattatttgcggatacttgggaatttctacgaatgcaactgctattcggaatatcattatgaatgggaacgaatgaattcataacctgaacattgccataggtaaacaatgaaaatctctgagttgatattcttttcctttgtgttccggttttcttcgaggacgtgccattttttttggctttaacagatttatttgtatcgtttgagtgttgggtcgaatcctgtttcaactttttattgttgctaagtttaagtgactgttttaaagtttgaaacgtagattgaggtttcttttcttgttttgccgttaatctcacgctatttttctttgtttctccccttgataaaaccataccactttgtttaatttcctgagagttatcagacgaaaaatgtagaccttgtatccttcataggtgaaggaatacttcctccgtaataaggtaatttaaagttcatagttcattcactctttttgtttacatctccgttcttcgtgataagttcatagataataagagaacaaagtatttaacgcacatgtataaatattgtattaaaagggtacctttataaatatgagatccgagggacgtttattggaattatcttttaaatcgtctatatcacatattccagtatacataagttttaattttagaaaacgtttaaataaacaaagagaaaaaaaataagacacaaaaaataacagtatctttattcttgacattcataaaaatgcatgataatattggtttcatggggtagtacttgtattattaaaagaaaggaacaaaaaattcattgttcaaaagcttagagataaaaaaaaagaattatagacacaaaagaaaaacatgggttaacattaattgacattaataatagaaagtgtaataaaaggtcattttcttttaatcaactctctttcttccaaccaaatggtcagcaatgagtctggtagcttgccagtgaatgacctttggcattctcatggaaacttcagtttcatagtcatacaattgtctaatggagttgtaaacgacatgtgaacccttaacaccaacgacagcagcagtgtcagaaatggtcttgtcatcagcgttgaagttttcttcggcagcacgagcttcagcaatggcagcttggttgtcttcgatgaagccgacagctttaatggccattctagtggctcttgttctatcaattggagatggcaaaccaccttgttgtacatgacctggataagctggcttagcgtcaaatctgccatcggcttcagcagtaataacttcagccaatttagtggctgataaagccttagaagcgtttgtactcttcaaaatcaatttaccaaatctacctctaccttctgccttttcaaaagattgagctaagtattcaatatcctcggacaattgctccaaagaaataccttcttctgggacataagagacttgagcaccaacagccaaagaagcgtaagtggccaaatagcctgagttaccaccttgacaatcgacaacgaaggctctacctctggttgaagaagcggattgtttaacaacatcacagtattccattagagcattcaaagcggtatcagaacccaaagagtattcagtacctggaacattgttagacaaagtagctggtatcaagaccattgggattctgaaagctggataactttctcttgctctctctaattgatgtaaagattcaaaagcttcgaaaccaccaacgatgatcaaaccatcaaattcgtacttttggaaatagtaagcaatcatacctagatctgcttcttctggagtgactctgttagtaccgatttcagaaccaccacgggattgccaacccaacatatccttccagttcaaagaacgaacactttcatgtcttgccaaaccagaccaaccattgtagatagcgtatggtctgtgaccttgggacatacagtaagtagccatcgagtagacggcagagttgataccaccagctggagcaccgacattaacaatggcaatcttcagtctcttgtcctttggtagctttggttcgttgtggtcagcagagttgatagccatgaaattgtttaaatgttcaatgaactcagtgtctcttaaagacatagctctcttgaaatccttagcttgaatggcttctgcaactgctttggtcaacttgacggattccattaatggtttacgaacaattttgttttcgttaacagcaatcaatggtgatggggtgtctggagtggattccaaaacggcattaacggcctcaagaccttgtaaagtagccaagatacggtcgtaagcaacagcagtaccacctctttgaacgtgacctaaggtagtaattcttgtatccaaacctaatctgtcaactagaactttgtggacgtcgcttggagaaattggggtcaagtcagcagcgatagcaccttctgcaacaacaacaatggtggttctcttaccccttgatctgtgcttggagacaatgtcacacatttgatcttgccattcgctggaagtggctggcttctctggaataaagatatagtcagcggaagtggcgataccagctaataaagctaaccaaccacagtttctacccataacttcaacaacgaaagctcttgagtgagagttggcagtggcttcaacgtaatcgatggccttacagattctgtccaaggcagagtaagcaccaatagtagcatccgtggtggacatatcgttatcaatagaaccgacagtaccgcaaatattcaaatgcttcattctttcgtattgttcgttggaaattctgtttgttttcaacaattcctcgatcaaagaaggccattctgatctaaacagatcagcaccagtcaaagaaccgtcaccaccacaaacgatcaaagcatcgacaccggcctcaatcaaatgttgggcacccaataatctaccttcgcgcttcttgaattccatacaacgggcagtaccaatgttggtaccaccttcagcagaccaaccacggacgtcttcccagtggaattccttgatgtattctggaccaccacgaaccaaaccttcataaccttccatgacaacaaaggcacgacaacctttgaagatagcggaacgcacgatggctctaacgttagagttcatacctggagcatcaccaccggaagtcatgacggcaattgccttttgaggcctgttcgatggctttggcagagatggataggtgtcggtggttttcatacggtaagccaaatcagtgtaagagtgaactttagaggaaagaccagactcagcagaagcttctggtgctggtggtggagttggcttggttgaaactgcgttcttagtagaagtaacaccaacaacgttacctaatgggtccaaagtgtacaactgcattggaaatagttctgttgggtagccttgaagaggagcgttcatagcatttagagtgtccttgactgccaagatgtcggaagtgttaaataccaaggattgggtggcatgtgatctccagtcttgagtcttggtaatactgttcaattccttcaaatgagcctcaacatttttattgattttttcatcaggacgtagaaggatcttcaaagagatggaatcgttagacaataaagtggagttttcatctggagaagagcggttttctaatgacaaaaacttggtgtaaaaatctatggcagctttataagattgaacggaatatgcagtgacggtacaataagaagtaccattcacaaaaggagtagtaacagtcattgcgtatggttagttcttggccaatgctaaactagtctctaaatctagttctattgttcaaatgagatataagaaaggcttttaagcaagaagaaggaaaaaaaaaaaaaaaaaaggaattttcttctttatgaaaccgaagataagaagcttttaatcaaggaagtaataaataaaggacaaaaagaagaaaaaaatattattgttttataaaatgcaagtaggaaaaataagaatgagagcggataaaaaaaaggcaggaaaaaaaacaacaacatgaagcgagagacttcattgcgatgtaataaatgaatggtcgataaagaccggatggaaaaaaaggccgatttaacatggcaaacaaaagattacatacgtactgatcaaattgatcaattcaatatctctgttttcgtttttaacattcaactaccgtcatagcgttatacgtaggaaaaaaaaaccgcaatcacgtaaccgtggcttccactaatcggctcttgtgccgtcagattccggatgtacgggtggacgccatttggaacgaaaaaaagaaattgaaaaaagtggaagctagaaatcactgtcttaccctggacggtatcgtatataatgactccggttttttttttctctacccccttgcctcttaccccggattttactcaactttatcttaatcttcgttttccttttagcgtggagatggtaaacgctagcggtaacgttaacgttgcaaagggggtatgcgggactggctgaaacgggcgatgatacgatgcaacaaagcagcagagaatggctatgaatagtctttacacccacagtttttcgtgtggcagttactatatattagtaggatattcgatctatatagatggtagtacttacaatgctgttcttgggtttttgcggatcttctttcttttttgtagttttattttatgtcttacttcttatttccttcttacttcctcattggttaaggctcacgttgattgcaataacaaagaagtatatactgtagcatagctcttcatatcatttttgccgtgcattcgaagactatatatatatatgcatattgtctgacctttcgccttaaagtaaagaagacaacagaatataaccatgctgagtagcagtagcaatagacccatatctgcccatctaaccatccattacaaggctattcaggaggaagagggggaggatatgagaagcggtgccggaagtggtggccatcatgacgactattttctggagagtaacagatctcccactcctaataagaaacatgagttcattaaaacggtgctcaatatcaacgataacgactctgaattttcggaatcgtgctcaccaagagagaagttacataacgagagggcttgtaatacagacctgttcggggacttcatgtctaaaagacaacagaggctgtctaattctatgaacatttacgacctttatcagtgtgtacataacctgtcgcctagcaacaacaaccatcagttcatagcaagaaggttcagcgattctcatattccctccttgcatcaccgccagcagcaacagaaggtaacaacaaaaaactttgtacagcccacgaaggacattcaaaggatcgcctcgtacgctgcggattcagaccagagagtcaagtatttaccaaactatcatcagtctgctccttctactgcactgtctgcggctgaatcgaaagcggctgtaccaagaaagctccctgacagagacagtacacaaaattacgtactaaaattgcaactctcgtcacccaactctcaaccaatgtcaccnnnnnnnnnnnnnnnnnnnnnnnnnnnnnnnnnnnnnnnnnnnnnnnnnnnnnnccgcccctcttgctcttcttccaattgctcgtcatcttcctcatcatcagcatgttcatccgtttccatctcagatccgaacaacataacagcatacgaaacgaataatgtcaaccctcagttccccagtaaccagccattagatatttctagtccttgtgcaaggcatcaccatagaagaaattctattgctgtaaaatttgacaaggctttatataagaaaacaacaggatagttgattagaagactatagctaaataatcatttcattgggaaatgactatcacgatttaacgaatacccccttttctctttcttgccatttaatggtcgtcgctctgatatttgcacacatacgctcacgtacatacgtacgcgcagatgggacaggcgcataagtacgcgctaatacatgtattgatataggttatgtttttatttattaaaatgatattgttgcatttttttttttaaatctcacgttatttttcatttatatacatacacttaagagaatgtcagattttctcttttcggccaccattatggtatctaagcggctatttaacttacttgttcctataccgaaactatctctttcgcttactgtccaccaacctagttagctcttcaaggacaatgtttccccttctgtcttcaaattttttcttaagctcatcgatcaacagcgagatctcaaactcttcaatgttcttgtcaatttttttcgaatttctttctatgaactccactactgctctgtcatcattaacatccagatcgttataccatgactgaactattttcaacaggtcgtcgtatttcattttcgttttgttatcacatgtttttttttgcagtcttttgatcacttgtccctcgttcaacctccttctcagtctccaatataaaaatctgcgtgactttttccattccaactcctttcggattactcctttaactagcatcctagtcgatctatcatgtaaatctgcaaactgtatgctgatttgattataaattggtatcaactgtctctctcttattttcaatctcttcgtaagatcattttgtttttccaaagataactttttttctgtcaacgttcttctcaaatgtccatatgtggagtctaatcgaatcatcgtctctatcattttctccttacggtattttatgctaactactccgtcaggttctaacacacctcccctagattcaacatcggcatacatttccatttgttcaggattaatagttggatctataacaacccatgatccgccccttaattcaccaaagggcggaatgtatatcagtatgggttgtttgtagtcaaccagagcgtcaacaataaaagacccgtactttagtacttcattgtacatatccctttgaccgccagaaaatcccctccaattggctaagataatcaatggtaattgctcaccatagttaaaatcatttatagtttgagctgttttgaacgcggaatttggataccacacctgtcctgcttctttaacggaaaactctgaagaatccagattagctgggtcagcggggattgtttcttcgatagtcttagtttctaccgcaataacacctacgggaatacctccaagacgtgctcttccaactattacacctttggcccatccagataatgtctcaaaaaacgaatccttatcaaataggcctgactggaagttgttatttgagtcccatttaccctctatcaaccaccttgcctcatatggcacttgcttggcaggtttgaagtctacatccctatcccatctatccatagtttcaagaagtggaggactcatatctcttttcgccgggacatatgataaccatgtcattattttttcgatggctttcatatcattactggctgttaaatgcgctattccgtttttatacatgatttgggttccgccaatttgtaggttagatgtatagatatcggtacccaaaactttattaatcgccgatgcacccgtcagtatgataggcttatcctccacctgaatagtacgttgtcctagtctgaccagataggaacctataccaacggaccgacaagtaacagcagtaatagtgaaaatgtctctatacgctttcgaagtggcaccagcaattaaacctgagccctgtaaacattcaacacctaaaccctcttcgaatccgactattgctttaataatatatctctcttcaccgtataccatcttgtgttcaacaacaaccgaatttcctttcccagaatctttcagtagctgcatgtcttttggagctaagtataagtactggaaaccctttgttggatcagaggggtcattccatgctacacgaaatagagggatcagctcttcggctatacccaatttagctcctgaattcgccgccaagtatatcctcgggatccctctctctcttgcataatttgtgaccctatcaaaaaacaaatcttctctcggtccaaaagatccaatattgtaggtaatatcattagaaatcacgatcatgttacgcccttcaggatattcaggtgtctgaaccataatctcaaaagcaaccatccctatattattaaggcctggctccctgtttacttttatcaaattaccgttttgttctatcaattcaacccaactaaaaaaactgtcattcagcttatgttttggaaaataccttttccactgttggattgcagcttgatgaaacagacctgggaaatcgtacacatatgttgtacccatgaattgagctttgtatcttttaggttgtagccaatccttgaccgagtaaggaagagagagagatttctggctataatggctctgctcactacacggttccaaaatcagattcccatttttccctatcttttcgtaatatgtctcaatttttaccacatacccagatttattagaaataagtaatctaagcggggctggcttctttgtttctaggcactcaacagagatgcaaatttctacatctgtgattctttcttgaaacaatctggtttcgtgagtctttagaattgtactcacaatttcctcgagacgatgtactggtatgttaagaactgtattgaaacttaaaaaaatatgattcaagtctgaatttgaggtgtcaactgctcctagatgttctaacatataaaccacttgagcattgatttccgctttcaagttttcttcggttgttttttgatcattatacatgaaggaatttatgattttcctgacaaagaaccttttatctagcggcgtaaatttgctaataccttcaaaaatgcgtatactactatcgtatgtaggtagtgatctgattttatagttcgacatttttcctaactctaacggtgcttcataggatggatccatatttcttatttgagagatttcatcgtacgtagttccatcaaaggagtaaaatttaacagtgggcgcattcgcggcgataaatgcaaatgtaatacgattaaccttgagcttggatagacctctctcattttcatgaagtttaatttttaaagttttaattagatcattttcacttctgtaacgaataggagataaaatattaacaataagagagttctctccgctggaaagtctttcctcaggaatatgaatttgttcgtatacctcgtctaatgtcttttccagagattcaagcgcacgcatgttgacaagaagaccaaaactatttgctgagctcttacctgatgttgagggaggtttagaaagttttgtaaactcatcactctcaccatcaggattgactaaataatttcttaatgagctgaattgccatgacattagtaaatcaggcgctcctttgtgaatcttaatactttttaattgataattgccgtaggcataccttgcataaatttcagatgctatactggaaagagccgtatcttgatggccaaaaaaaaagaacaaatcctgaagttgtatcagatttgaatgtattaaattaccaaaatccctcatacaggaatatatgttcctgctgtgaatgtttttggcaccagtatcctttatgtgcaattgcaggagagttttaatatgctcttttcttttctttatgggagggaaaatccctctgagtagcactgatcttgcctttacagcaacctccttagcccacttagattccaaacttgccaaatcatgtataacagccctgaattttaaagacatcttagaggaatcctggcacaatggctcgtattcatgcaatattgcagttactaacttgttctttgcgactacgttagcatgcgataaacttatgcacaaaatttcttttaagtttgtaaggtctttcctccgcagatttagtaagtttctttcttcatgtatatcatgattttcaaaaattttctcaacagcataatactttttaatcaactttaaaaaaatttcacattcgtgattagctaaaccttcgctatacctttcactaattttaagaagtggctgtaaggcaacataaactacatgatcatttgtattttcttccaagtagcgcttcattaatttgtgcagttcctttgcaggaaaagaaacagatttcttgactagatttcccagcccctcattcaattgccttggtagtctattgcgtaccgtagaaatttgggaatcccattctgaataaggaagcctaccatctctcaatatttttatcaactcttttagagtagtttctattccagagttttcatgatatccattgagaatattttctaacctatttattaagactctgagcttatggtttggtcggctaccctctattagcggtggacctaaaacaggtaattctccgcggtataaagacgattcgttagctttggacggtgaatccaaagtcaattttgcgatgacatcaccagcctcaattatggaaccgggctgtcttagtaactcaattacaccatcacttttcgctactagtggcatctgcattttcattatttctatttctgcatattgctgtccagcaaaaacgtgatcaccacttcggaccaaatatttcaccaatttccccggagttggagagatcacttgagtgggattgagttcagcttctaaaaatatggtattggagtctatcgaaagtcttgtacctctgatatcgtccttccaataaactgtatggcatttaccgtcaacggagatcaacaagcagtcaccggacaatttttgaacattaacttcacattgagacttattgatagaaagaataaattgttcttcagatgattgagcaacattgaacaagtatctattattatcgaaaatgaagtcaacaggaaacttcgttttaagaaaatctttaggtggaacttggcccctccgcaataattccaaatacttattcctcaccttttctgtgaaaacgtatgctttcattgcggcaccacagataatagcgagcgttggatctagtttgctatcggaagataaatttttcaaaatcaaatcatctaaccaaccagtcgatatgttattactctcaaagtcccgagtttctaatagctctatcaggtactctataggggttttgaattctcctcggatggaaaaatcttttagagctaaaaccatgttttgctttgcatcttgcctatcgtttcctacagcaaaaatgtgcccaaattgggaatctgaaaatgagtgaatagcaccattatttcctactgagaagtaaccccaaacattggaagaagaacgaaaattgagctcatgtattttcccagtggagggcttgaaaccttcattaggatcttctgaagtgatcctgcatgaaatacaatggccttttggcgagggtctctttaaatttttaaaatcaatatacgaagttcccgttggatctaaaccataaagttttctgatatcacttatcatgtgcataggaatacccatggcgatttgcagttgagtggcaggaaggtttacgccagatatcatttctgtcgttggatgctctacttgtagtcttggattcagttctaaaaagtaaaatttatcatcttttggtgaatataagtattcgacagtgcccgcagaaacataacctaccaattcacctagacgaattgctgcgcgttccatcctttgaaacgtttcaggcttggttattgtcactggtgcctcttctataatcttttggtgccgcctttgtatggaacagtctctcccaaacaatgtaatgttagtgccatattggtcagctaataactgtacctctaagtgacgagcatcagtgacaactttcataacaaacataggcgacccaggtgtctcattcactgcttggcgatataatgcaataaaatcatcctcattatctactcgcctaatgcccttacctccaccaccttcggatgccttaatcattacaggaaatcctattaatttagccttttctaaagcatcttcaggtgaggaacaacatccccttacatatacatcatccggcacagatacaaagttcgtcttgttatcgatatggatagtgtctatatgtgaaccagaccaagggatacacgggattttagcgctttgtgctacaatagtggaagaaatcttgtcacccaatgatctcatagcgcgtccaggaggaccaatgaatagtattttcctttgtgaactagctaacagctcaggaagacacggattttcagaagcatggccccatccagcccagaccgcatccacatccgtttgctctgccacgtccagtattaagtctatgttggcgtaattgttgttgttggtaccccctggtacctgcacatattggtctgccattctaatatactccgaatttgcgtgtaaatcatcaggtgtcgccattaccacgaattgaatgattttttcatcattgaacgtctcgtacgcccattttcttatagatctcatttctttcaccgcagcaataccattgtttgctattaagatctttgaaataacagtatgcccaccacgtaaatcaacaaaatctcttaatatcgaaggttgggcactttccacagtatttagccctatgaactggggcggtaatcgagtatgtttatgaatattgcctcgatccacataattggaataccttcttctagatggaaaattcaaacctattcgagatgaatgcctatacgaatgggcaaaaatgcgttttctgtattcagggcgctgtcctttcaaccgtactatctggctgcccgttatattatagaatcgataaggatccaaatataacgcgagcttgtactgtcctattcgaatgcaagtaattgtgaatatggtaatgtaaaaatgagaatgtatccggcgagccccccagctttggccgtgtgtaattgtcttccctttctacccaagatgacttcttctttatcattcttcattattcatcttttcttgtcatctgccgcccacccattttagttaccctaacggaaacattgatgaatgatgctattattactgtcataagcaataaaaagagaggttcctactacttctcccatggaaagctagcgatagccttgtactctatctcactttcagaatgcgtacacatttatgtttaaagaggcgttttgtgctagttttgtctcaacgtgtattttatcggttgtaattgtactgacaattttcgggcctcgtttggctgtcgcactgaaatcttcgacagggtatcgaagaacgatacaacgatatgcctataaaggttagttagccatgatattacttcctggtttgctggtgcgcttcttagtcctaacttgcaaatttatatctacgtatagaaaactgtcaatatgtcattaccgttcttaacttctgcaccgggaaaggttattatttttggtgaacactctgctgtgtacaacaagcctgccgtcgctgctagtgtgtctgcgttgagaacctacctgctaataagcgagtcatctgcaccagatactattgaattggacttcccggacattagctttaatcataagtggtccatcaatgatttcaatgccatcaccgaggatcaagtaaactcccaaaaattggccaaggctcaacaagccaccgatggcttgtctcaggaactcgttagtcttttggatccgttgttagctcaactatccgaatccttccactaccatgcagcgttttgtttcctgtatatgtttgtttgcctatgcccccatgccaagaatattaagttttctttaaagtctactttacccatcggtgctgggttgggctcaagcgcctctatttctgtatcactggccttagctatggcctacttgggggggttaataggatctaatgacttggaaaagctgtcagaaaacgataagcatatagtgaatcaatgggccttcataggtgaaaagtgtattcacggtaccccttcaggaatagataacgctgtggccacttatggtaatgccctgctatttgaaaaagactcacataatggaacaataaacacaaacaattttaagttcttagatgatttcccagccattccaatgatcctaacctatactagaattccaaggtctacaaaagatcttgttgctcgcgttcgtgtgttggtcaccgagaaatttcctgaagttatgaagccaattctagatgccatgggtgaatgtgccctacaaggcttagagatcatgactaagttaagtaaatgtaaaggcaccgatgacgaggctgtagaaactaataatgaactgtatgaacaactattggaattgataagaataaatcatggactgcttgtctcaatcggtgtttctcatcctggattagaacttattaaaaatctgagcgatgatttgagaattggctccacaaaacttaccggtgctggtggcggcggttgctctttgactttgttacgaagagacattactcaagagcaaattgacagtttcaaaaagaaattgcaagatgattttagttacgagacatttgaaacagacttgggtgggactggctgctgtttgttaagcgcaaaaaatttgaataaagatcttaaaatcaaatccctagtattccaattatttgaaaataaaactaccacaaagcaacaaattgacgatctattattgccaggaaacacgaatttaccatggacttcataagctaatttgcgataggcattatttattagttgtttttaatcttaactgtgtatgaagttttatgtaataaagatagaaagagaaacaaaaaaaaatttttcgtagtatcaattcagctttcgaagacagaatgaaatttaagcagaccatagtatccttgatacattgactcataatcagttaaatagccattcaatccctttgagctatcaacttcatattcctccacaaggtccttccacccgcgaattttacgcagccgacttaattcatctcctgtaaattggaccaagggtttggtgccatactttaatggacctacattgacccaatgcagctctttacagtatttctttagtgcttcaatactggatagatattcaaacatattttccgcggtatctatgaaatatgcgctacaaatgataattttatcatagtctttggaaatgggagaatatcgtgtgaagtccccccatagtgggtccagattactgcggtggccaactttgctcaaatctgccgataaacttctcaactgattatcaaacactgtctggcatgaatattgttgtacaaaaggacgtatcttaacgtcatgcttatattcgagtgcaaataggttacatatgtacatcaaggctgataattcgatggagtccacctgtattttggggaaagtggtggcaagagtatgggataggccacccacaccagcccctggggtcacgataagaattttctctttcatgtccccggcactaatcacatgatggttgattctactaatgataaaattttgtaaaggatctctttccacactatagtaagagctgaaatcacgacacaaatgtgctaatgcttcatggaccacactttggctgcctcgagacgaaactattggaaatacgaagtcaggattcaattgaataaggtgaccatctttaatcttatagccgtgttccgcgcatattttttcaatttcctctgtaaattcttcatcgtgttcgttggaatgaatcaatttccctaaagtgaactcaattatcttgtcaataactcttgcgttttctcggataccctcattatttttcattaatttggtgaagtagcctaatttttgcaactgatcttctgaaattccatttaattgtcttgctctccgaaataaaaggccattatagccttctcctcttgctcgatactcatgtaaacggattaaattccccgtaagatcaggaagagtgggaatctgataattaattttagaaagattcgattgatcggcagatattgatttctcaacatcaaccaattttaaggagggcgataaaacgctgactttttgggccagatttgattttcttgataatagcttttcaacatatgatacaaaccacttctgcaacggcttattttgccttagcagtgtcatcaggactaccacaagggctagaattatatttgatgccagtgagctaaccattggcgctcctcaacttcgtatatcaatatttttacctcttctattttctgaaaaatttgttaattgtacagcatcgtttacgtttttttttttacgggtcttcttacctaaccccgaaaagtattgtggatcttaaaagggtctaaattatttgaagttcgataaaaaccaactactttgttattttaaaactgtattatacaaacgctggtaaacttccagagacgatatgcgtctaaaagaattgttacctaattttttgatcgttcatcaagaggtccctgaggatcctattgcattcaagtccaccgataaacgagagaatgaaaataaagagatcaccatccctgagctaatagatactaaagttcctgaattagctgacggtgctactgacactttatatggtttactggtcaatggccatttacaaactgcatatggttcctttagacactttgacaatatatacaaagttcaatataaaagaatgataatcaaatacccacatgggggagaagggactgtggattttgctgtaaatggtagaagtaccaaaagaagaaaagtggaaaaagaatacgtgccgacaagtcaaccggtatttaacggaaacttgaaacgaagatattcgtactattcccctgatgatcctaaattgaactcagacgatgctaagcctatgcttattattctccatggattaacagggggttccagggaaagctacgtgaggacaattgttcatgaaatcaccacgaagtatgactttgaagcatgcgtgtttaatgctagaggatgttgttattctgcaattacaacgccgctattatacaacggtggttggaccaatgatataagatattgtgttaatgacttgaggaaaagatttccgaatagaaagttttatatgatgggattttcgttaggcgcatctataatgacaaattatttgggagaagagtcagatcgtactaaaatcgaatgtgctatttccgtgagtaatccatttgacctgtacaactctgcatactttattaacagtacaccaatggggtcacgattttattcacctgctttgggtcacaacttgctacgcatggttcgaaaccatctctctactctggaagaaaaccctgatttcaaagatgttatcgagaagcatttaaaaaagattcgcactgtgaggcaatttgataacttgttgacaggcccaatgtttggatataaaaatgcagaggagtattacaagaatgcttcatcatataaaagaatacccgggatcagaactccttttatagctttgcatgctcaggatgacccaattgtcggaggtgatcttcctatagaccaaataaaatccaatccatacactttgcttctagaaacttcgacgggggggcatgttggatggttcaaagacagatccggcagaaggtggtacgcagaacccttatgcagatttttgaaaatatttcacgacgaaattactgtaaagggcttaaaacctgacttggaaaatgttcaactcccagatcctaattgcgaacccatagccacaacctttcgcgcgaattagtttgtaaataagtcaactttttagatgtgtaacctgataatttttttttgatgttcgacatcattatttctgaatgaaaacgtgaaaagcttcgccaaacttaaaatggaaaatttcgaatgggacaaaaatataatcgatgcgatgaattaaaaccttggaagaagagggttaattgttaaaattacatatattattggcagacaagaatacaaaatgcatgaagtagtaacgatatcggtttcgcagagagcaaaccatttgactactcaattcttcaatatacaagagggctatttacaattgtctaaagaacaacaagtcaatgactccaaaatttttctgaattcggttgtagataaagtttcaaaaacaatttcatatgcaccacgtgccttactttgggatgcccgtacaggtaatggttcactaggaacatatcaatattcagaaagccaagactatcatttcggcaatgaagacaaattcaaggagcaaacagttataaagactcatccaagaatacctaaatccgaatatcagagttctctagatgcaggagcaccgctgccttgtttgaacagagaaaatacgaagtattggtctgactattctaaacttatctatggtccttcaagtttcaatattttgagaaattggtaccatgacactgaaaatccaaaccaacctgactttcaaaacttgggggagcgaaagtttgacaggtattccattggttatgacgaatttaccgaaaattacttgcaagagttttttgatggaaatttgcatagagaattggaaaaatgtgacaccctgcaaggcttcaatcttgtaagtgatatggagagtggatggggcgggttttctagtgctctactggtggaattaaggaatgaattacctaaaaaggcggtcttttcatggggacacaatgaagatgatccattcacagatgacttccctatgaaaagactttcaaagaaatggctcccgatcatttcgaacaaattaagaagcacaataaatatgatgcaagaatccgatctttacttcccattgtatgctgctcctggactaactaattgggaaactgctggaaagagctgtaggatatttgattctataaatgcgacaatttcccaaagcaatcttgaacaaagaaagacgatggattatctaacaactgccattaccttaggatattcgtcgcgaaatatggtcactggcatggttatcggtgacaccgattactcattctgttctcgagtacttcctttcaagaatagccacaaaccaaattctgctcacatattttcaaaaagtttcattgatagaggaaatcaaacgcataaacatcattccgaacctgattcacggagtaaaatgattgaaatatatacacacaggtattttccatctgatacgataccgacagaattttccaatgatcgtgaatttgttttggaattagaatcatctgaaaaaaatcgagatatattcaaacattggaatgagtttgtggtaaggtacttcaaaaatgatagtgacagagaagaattgaaaaatgaactttccgattacgtctcagcgtacgaatctgggtggtatgaagacgaagattctggtgatgacgatatgtgataagcagtttgcagctacgtatttcctttctccagttgaggcaaacaggacttcttccatctttttcgaagtttttacttcgccatttgatctatatctacgtaaattacattaattagaaagtcatgctatatcactcttgcccttgaaagcatccacaactgtccgtcaaaaacttaatttctcaagtggaggagaatattttacctcttgaacttaaagaatgtaaatcttcatttgcgtctttaaagtcatcgttttgattttcaccagttgctgttttttgcaaaaaggattttctatttccaatgctactgcgatcagaaagactagatattggtgcaagtcgcagagaatttgatctagcaacgtcgattttatccaagccaacaatattctcctcatcaggatctttgattttattcgcgtcatctgaaaaagttttcaattcatttaataaaaatgtgatattagtgacacgagatttcactgattgagaaccccgaaaagagccatctcttttcatattatttggaatattcttttcattcattgtttttttcaaatcgctaacttttggtgcggtggctctcattgttttccatgatcttgcgtcctcagcaacaaacctatagatactaccttttgcattagcatcagaaattacagtatcgttagcttcttctatattgtcatctatgctgttgtcgaatttattttgcttggccgcaaaatcgttgttatcatacactgctttcccatttgaaaaaatagcattagggacattcttgtactccagaggtgtagtacgaacttgagagtccgacagtaagtcagaagtagaaatttgattatcacgagacaataaaatctgcgcccccttcttgctgtatttatttgatccagtatcagaatagtatgacaataaatcttccttggtaaacaaagttctagtttgcattttgtactcagtttgtgacttgtagtcattgagttttaaaaagttagctgcttgtaaatggtacgaataataggtatactcaggctcagaaacgttctctagaaaataattcaaaccggataatagtgccatttttccatacttgtcaaagatctcttccatcatttctttttgcacaccatgtgaatccagttcacgtaataatgagtacagttttgaaaagaggatgctgcttggaacctcagtttcaacaatgttaaataaacatataatatggtttttcatgtaatgcgccaagtcgatgaataattccaagctgatacttggctgcgtaatatgttcaacgaggaaatcaatatcttccacaactgcattcttttcaacatccttgacggcgtcacttttcaatttcaatagtagttcatataacatatctgaggtctgttcagcgtaataagttttatggttaaggtctgtcatggtgatacaagactgtgccacaacctctttattagttgcatttttcaactggaaatttaaaagttttctcattatatcaagaacactcaaacccactatactgacatctgaaacaagtaatgacgacatcaatttcaaggaaacaattggatttacatttttatccttgtcgcttagttgtctgaccaaaagaagtataacaatatatcgtaactgaacaggtataccattgcatacaaactctagcagttccttattaggtgtactttgcagacagcgcaacagagtacgaatagacaaattcaatttgtctgtctcagttgtgttaaaataggattgcaatgcttttactgaaaggtcatgattatcttcggcggccttatctaacccaattgtacgagtttgtgttcgacttagcctttttcctaaattgctctccagagctgtttccagcgacaaagttttgaatttcggatttctctcttggaactttgaaatagtataggcaacagacttggaaacaaagtggtttagttgtgggttgcttgaaacactatttgtgtttgatatatcaatacagcatttcagaagcatgtcatcattatgaattctttcagtaactattttaaaaaaaagatcaacaaagttctggtataactggacgaattccatatcaccgttacacaagacgtcgtccaagttctggcatatactactaaatgccagttctattaattcaacaacagatacatcattgttaaaattgttgttggaaagaactttgttcataatgtacaaaaaatctttaacaaatacattcaaattctccttacaatgcaacacaattttgttcattaaatccaatgtaacgactatgttccctatgcgccgatgatttaagtcggaggtggaacgcttaatcaggtaagtgctaactttctccaatttactacgcctcgagttaacgtaatatagcaaatatgaagtttccgaagatttaggcttcttatctgtggtccttcccgtaggataacattgattgaccagtttctgatgttttggtgtgaacatcatccgcatagacaactgcatcgcaaaccactttcagaacaattgaaaatgaacgaaagatgaataatagagcgaatgatctgggttcaatatacagtctgccactgaattaatactactccaatagcgaggttgctcacaatactttcaatttatcctggttgcctggctttttcaacaaaaccattaccttcctattagttcgaacaaaattttcttcctcttcttttggccggggttgaagtttaatgaaaaattaatgctatgaactattatgacaaaaaagcatatgcgactcaggaagatagtaaagaaaaaaagcaaaacatctctaagaggactatactagcatttcaagatgccccccgtaccaatatacgtgaaaggtggtgtatggaccaatgtggaggatcagattcttaaagcggctgtacaaaaatacggaactcatcagtggagcaaagtagcatcccttttgcagaaaaagactgccaggcagagtgaattaaggtggaatgaatatttaaatccaaagttgaattttacagagttctcgaaggaggaggatgcccaacttctagatcttgcaagagagctgcctaatcagtggaggaccatagctgatatgatggccaggcctgcacaggtctgcgtcgaaagatataataggctattagaaagtgaagacagtggaggggctgcgttaagtacaggagttactgacttgaaagtcggggatattaatcctaacgctgaaactcaaatggctagaccagataatggtgatttggaagatgaggaaaaggaaatgcttgctgaagctagggctcgtctgttaaatacccaaggtaagaaggctacaagaaagattagagagcggatgctcgaagaatcaaaacgtattgctgaactacaaaagaggcgtgagctaaagcaagcaggaattaatgttgccattaagaaaccgaaaaaaaaatacggcaccgacattgattacaatgaagatatagtatatgaacaagctcccatgccaggtatatatgacacgtccactgaagaccgccagataaaaaagaagtttgagcagtttgagagaaaagtcaacagaaaaggtttggatggtaataaggataagccaagtaaaaaaaataaggacaaaaaaagaaaacatgatgagaacgaacacgttgagaaagcagcactgggtgaatctactacattgacagatgagtataaaaaaccaaaacttatactatctgcaccaggaacgaaacagggaaaagtcacctataaaaaaaagctagaaagcaaaagacaaaaactaatcgaggcacaagcaactggcactgtgttgacaccaaaagaactactaccccacgaacccggccaagaagataatgaacgcagtaatataaagagtggtaaacagctaaaatcacgcatacgaaaatttttagtgcaaatgttcgcatctttgcctagtcccaagaacgatttcgaaattgtattaagtgaagacgagaaagaagaagatgcagagatagcggaatacgagaaagaatttgaaaatgaaagagcgatgaatgaagaggacaacttcatagaaccaccatctcaaaatgatgcgccacgcgtctcattagtagccgttccattagcctactcaacactacccataccagaattcaaaaacaatccgcagtccgcgattgacaataagtacaacttgctagtcgccaacgccataaacaaagaacctcacatggtaccagaagatacggtagattttctcaaagaggtggagtcgcgtatgcagcatataacccaagggcgcacttccatgaaaatacaattcaaaacagcaatgcccccaactgaggttcttctggaatcgatccaatcaaaagtggagtctattgaacagttacagcgtaaactgcaacatgtgcaaccactggaacaacagaataacgagatgtgcagtaccctctgccatcacagcctgcccgctttgattgaagggcaacgcaagtactacgctgattactacgcctaccgacaagagatacgatcgcttgagggtcgtagaaagcgtcttcaggccatgctaaattcttcttcttccatatagcattagtatagcattaatataacttttatgaactaggacataggggacttgtgacaacgcattacccggagttagaacgttttcttgccaagttggccacatcggcaaaccagcgatggtaataagatgtagtagtactgacaaaacatagtggataggccagaagagcgtgcattggctggcgaaaagatcgaggacaatgattccaaaattatatatacatttgatactatctttattgttgttgccgctaattttggcgcaggattattatgcaatactggagatagacaaagatgccactgagaaggaaatcaaatcagcgtacagacaattgtctaagaagtaccatccggataaaaatgctgggagcgaagaagcccaccaaaaattcattgaagtcggcgaggcatacgatgtattgagcgatcctgaaaagaaaaagatttatgaccagtttggtgcagatgctgtaaagaatggcggtggcggtggcggtccaggaggccctggcgcaggtggattccacgatccgtttgacatattcgaacggatgtttcaaggaggtcatggaggtcctggcggtggatttggccagagacagaggcagcgtggtccaatgatcaaggtccaggaaaaactgtctttaaagcaattttattccgggtcctcgatagaatttactttaaacctaaacgatgaatgtgatgcatgccatggtagtggctctgcagatggtaagctggcccaatgtcccgattgtcaaggtcgtggggttataatacaagtgctgcgcatgggtattatgacgcagcagattcaacagatgtgtggtaggtgtggtggtacgggacaaattatcaaaaatgaatgcaaaacatgtcacggcaaaaaagttaccaaaaagaacaagttcttccacgttgacgttccaccaggcgcaccaagaaactacatggacacaagagtcggcgaggctgaaaaagggcctgactttgacgccggtgacttggtcatagaattcaaggaaaaggatactgagaacatgggttacagaagaagaggcgacaatctgtacagaacagaagttctttctgctgcggaagcgctatacggcggatggcaaagaatgatagaattccttgatgagaacaagcccgttaagttatctagacccgctcatgtagttgtctccaatggcgaagttgaagtcgtgaagggattcggcatgcccaagggtagcaagggttacggtgatttgtacatagactacgtcgttgtcatgccaaagactttcaaatctgggcaaaatatgctcaaagatgagttgtagacagataatcctacgtacgcacacatgcatatatagatagacaactggtcttctgcatccggtaataggcattggctttaatactaataaaagcaagaaaaaagcgacaccagtaaatttcagacatcttcgagaattttttcgcgcgctttctatcaaaaaaaaatgaaaaataaataaataaacaaaggaaaataaacaacaacatatactgttcttatataacatagaacatctattgtttccgtgttttgctctttcctgcttttgttcgatcaaagatcacaggtctcaaagtcgtttagctagcgatgcaactatctaaaagtatactactggcagcattagctgctacaccatctctggtgaatgccatgctccccatccatatcaagaattataggttcattaagccatcctctgccacaaatagcgaatccgataacgaagttttttttgtgaaaggtgtcgactatcagcctggtgggtcgtctggttacgatgctgactctgatacagatattctttctgaccctgaagtgtgtgccagagacgcctacgctttccaacaacttggtgtcaacacagtgagaatttactccctgaaccctgacctaaatcatgacaagtgcatgactatcttcaacaatgctggtatctacgccattttggatgttaatagtggtaattacggggagagtttgaaccgtgctgacccatctggaacatatgactctttgtatttgtcaagagtcttcaaatttattgacgctttcaagaactatcctaacgtgctaggattcttttctggcaacgaagtcataaatgatcaaagcgactatgcaaaaattgatcctccatacatccgcgctgttcaaagagatatgaaacagtatatttcaaaacatgcgaacagaagcatcccagtcggatattctgctgctgacaatactgatttgaggttagcaaccttcaagtacttgcagtgtaattcgttggatggaaacaaagtcaatgatgatttggacatatctagatctgatttctttggcctaaatacttatgaatggtgctctggcacttctagttgggaatcttctggctatgacaagttaaactcaactttcgaagatgctgttattccgttgatattttctgagtatggttgcaacaaaaatacaccaagaacttttgacgaagtctctgagggtttgtatggtggtttaaagaacgtcttctctggtgggttggtatacgaatacactgaagaagctaataattacggtttggttaagcttgatgatagcggttctttaacttataaggatgattttgttaatttagaatcacaattgaagaacgtttcattgccaacaacaaaagaaagcgaaatatcttctgactctatctacaagtgtgataacagtgccatcaccaatatttattctggctttggaacgaacaatttcactttgccttctcaaccagcagaaattgccaatatgattaaatacggtgttaatggcaccaacaccggtaagatattgactgattatgctgttccaactacttttaactatacaattaaaaacaataaagatgataccatttcagctactatttcatacgacaaagctaactcactgaacgaactagacgtcacagccacaacggtcgcaaattcagcttccacatcacaatcatcttctcgctccttaacttcaagcaccagtccatcttcaagcactggctcatcttcaagcaccggttcatcttcaggttcaagcagctccaaaagtaaaggcgtcggaaatattgttaatgtttcctttagtcagtctggataccttgcattatttgcaggtctgatttctgctctactctgagctgctcatgtatttttttgaaacatccatggacttgttttcgttttcaaccgttttatttttttgtgttcttttatcttaacatatgtaaaacaatttatatgtttttaaatagtaaacttttcatcaaaaacgcttaggtatcacacccatcatccttcaccaggacaaccattgggtgcaaaaaataaaatcaaaaaatgtcgagtatggattcaaaaaccgctaaagataaaagaaaggagaatcagcataatcttttgttgttacttcagaatattatactaggtgttacaaatttactttggtaaaaaaaaaaaaaaattgcaaaaaaactactgaaaaataaacaactgagcagagaactaaagtatgcaaaaaagaggttaaacagaaaaaaaagtaaaaggcaagggcaaaataaaggtataaaggtaatcaatgtcttttatgatcgcggacttcttcaaaccatccggggatatcggaaccactcccgtacaactctctatcaggtacccgaatctcttccatacccaaggtatccttgagccatggatggttaaccaagccacctgcatcagctcttttccttgggtctagctgtaacataggcgacaaaaaatcagatatttccttggcttcgtccttagaaaacttatatttttcagttaaaacatcttttaagggccaaaatttcaatttcgagatatttcttaaaagccctcttgaattgaagaaagttcttgtatatttgccgttcctcaaaaggtatgatggtaattctcccaataactcgatgatttgtgcaatatggtcatcatccttagtgtaggaatgaccttcgtccggttcgaaaagaaaatctccggtaatcaattcaaaaattagacaagcagtagaccatatatctgcaccacaaccccaaggggcgcctagtaacacctctggtgatctatattctcttgtctgtatagaattcgtgtaatgttcgtcataccaacaagcattacctaaatcagcaatcttgatctgaatcaaattttctggggagttgatatcggtactgacgtttgaatttgaatccatagtattagaaatatatggaccatttgtatcggagctttgtgatatattggaaatatcaaatgtagataaagagtctgccagctgctcttcatgcaaaggtgtgttcattatgtcctcgttattattgttgttgctgttgttattgttgttatttttatttttactattatcattattgttgttatcattactgtcttcatttatgaacatcctggtcacagaatgtggtactgaatttaagaaactattgttgctattcttaatgcctatgccattattaatactgttattattgatggaagatggaatgttcctattcccagatacggaggaaaagctattgtgactactaccacaaaagtgcgccctcatttcaaagaaatttgatgaactaattggggaaggtaatggttgcgaccctgtgataattgtatgacgtctaggtcttctaaagcatctttttgacaagtccttctctatagaacgagatttggaatttgagcttgagccgcagggcatacttgtttggcattctgcccatttctcatcactgctatcgttcgcggtaatatcagaagaccgcgaaacgtgcctctgcaacctttttgcctctctcttctgtttatccagtgcctcgaccatttgaacgataccctcaacatctccaatctccatcaacacgttttctggtttaatatctgtgtgtataataccacaccgcctatgcatgtaatcaagaccaagcagtaactgcttcgatatttgcttgacataaatcaatggaatgcccctatgttcatacttctttatcaaagccagtaagttctcgccgaggacttcaaataccataaccacatggacgccattggggcccttatggttgaaatgatctagcaatttcaaaatatgattagcccccatggaatcctcctttgtattatcggcgtcattcactctttgcaaaagcttaatttcgtcttcagcagcttcagtgtaaactttgtcgccccgaacaatcttcatagcaacgtgagtgttgtttaccatatcctttgccaaccaaacggtggagaagtggccccatcccagctttcttactaaaatgtagcgtgcatccttatagggctcgcccttaaaggcagggtggtacccacccggcctgtaatctttcaaagactcttcgttcctttcgtcacatgatgagatagaggaatctgaatccaaatctgagtctgattgtggccccgaatccgattggatggacacatgcgattcaacgccgctatctggttttttcttaatgctctttgtagaaaaatcttctgtcttcgaggaagtatcctcttgtacagtaccgttggcactagaggatgacttggaagtctgcaaggccaaagacagtttagacttcgttggagcaggcgccttcttcatcatgttataatccctttgaaagaaattcttcttcgcttcctgcgagcttgttgcttcctcacatgaaatgctcgcatccgtactagtgtcagccaaatgagcgcttttagtcacaaacccaggatagttaattgatgaacccattaatgtctacacttcttctttactctatctcttcaacctcaaaagggggtgtctatttataccaaaaaacacaattatttctcagcgccaggtgatctaacaattttgaatcagttttccaatctctattaacttgccagctacaaatagatccctctatatcctgtgacttctctatagctctttcatagcccacactcattgcttattctctttcaaataaataacacgataagatttagaaaaatagaaaaagaaattagaaaaaaatccggaaataatataggctcgtccgtaacgatttaatatcacgtggatagtgatataattatgaggtgttgccaaatagaacctttaattatgtttaacagcgaaaaaacaaggttgtcaagtagccgactcatttcttcgtgacgttggtgacaggaatatgctttcatcctctcgctcccctacaatggcttcggttcccgacattttgactcttttcatgccgtcatttctttttcttgcttgcaggaaatgaaaatttttttttttctttggcgatgagcatcgagaaaaaaaatttcttttttttatcattttttcagtttcattttcatttcacagttataaaacattagttaagttatagtttcggtcacggtagtctctaattagcttgcgttcgttgtagtttaacttccctgggtcatttggtaggtaatatctatattctaaaataaactaacgacatcaatattcacaatggctgccggtgaacaagtttctaacatgtttgacactatcttagtgttagactttggttctcaatactctcatttgattaccagaagattaagagagtttaacatctatgctgagatgttgccatgcactcagaagatctctgagttgggctggactccaaagggtgtcattctttctggtggtccatattccgtatacgctgaagacgctccacacgtagaccatgctatctttgatttgaacgttccaatcctaggtatctgttatggtatgcaagaattggcttggattaatggtaaacaagttggtcgtggtgacaagagagagtacggtcctgccactttgaaggtgattgacgattccaactctctattcaaaggtatgaacgactctactgtctggatgtctcacggtgataaattgcacggcttgccaactggttacaagaccattgccacctccgataactccccatactgtggtattgtccacgaaactaagccaatctatggtattcaattccacccagaagttacacattctacccaaggtaagactcttttgaaaaacttcgccgttgatttgtgtcacgctaagcaaaactggactatggaaaactttatcgacactgaaataaacagaatcagaaaactggtcggtccaactgctgaagtcattggtgctgtttccggtggtgttgattctactgttgcatccaaattgatgacagaagccatcggtgatagattccatgccatcttggtcgataacggtgttttgagattaaatgaagctgctaacgttaaaaagacccttgtcgaaggtttaggtatcaacttgatggttgtcgatgcttccgaagaatttttaagtaaattgaagggtgtcactgacccagaaaagaagagaaagattattggtaacacatttatccacgtctttgaaagagaagctgaaaaaattaagccaaaagatggtaaggagattcaattcctgttacaaggtactctttatccagatgtcatcgaatccatttctttcaaaggtccttctcaaaccattaaaactcatcacaacgtcggtggtttactagagaacatgaaattaaagctaattgaaccattgagagaactgttcaaagacgaagtcaggcatctaggtgaattattaggaatccctcatgatctagtctggagacaccctttccctggtccaggtattgctattcgtgttctaggtgaagttactaaggaacaagtcgaaatagcaagaaaagctgacaacatttacattgaagaaatcaagaaggccggcttatacaaccaaatttcccaagcctttgcctgtttgttgcccgttaaatccgttggtgttatgggtgaccaaagaacctatgatcaagttattgctttgagggccattgaaactactgatttcatgactgctgactggttcccattcgaacacagtttcttgaagaaagtcgcctcaagaattgtcaatgaagtcgatggggttgctagggtcacttacgatataacttccaaacctcctgcaactgttgaatgggaatgattcatttctattttaacattttctatatatatatatatataagcctagtacaaatataattcatcaacgttcaaatattaaagcatactttttgcacaataacagcaggagagatgcaggtaggatgcgaagaagaaaaaacctattgtattatcttgtacataagtatgcaccttcgcctgcatacggcttattttaaaaaattaaaattgactcaaatgcattagagtgatcaactctacaacttttaccatttatgttggtaatttcaacacgcggaaaatttaagtagcccttttttaaaggaatcaaatggacttcaaactcctttcttttctcttttattgcgcaacgtttctggccatgaattaaccattcattactgctcaaaatttcaaaaatatatcctccgtcatctataacatcttgcccccattgtccactgagattttccacaattacagtataggaaagaggattgcctatggtagctatagtatcgtgtagcgcatcgtggctagtttccattggctcgaattgtacatgaaagaattgttcaaaacctggtagttgtaccggaacagttaactgtttcggtaccagatttctcacatactcatccatatcagtattacatactgcaattcctctactcactttattcaagcagatcaatattttgtcaaggaccgctttttcaatgcataggttacgtatcttcgactttgttttattcaggtctattgaagtctttaataatctaattatcctgttttctttgaatgcatcataatcgtatttcaactttttcaaaatttctaattcccaaaatgttttccacttttcaaacagaataaaccattcaacatcaccttcaataagcacggcgtctgtaataaagcaatctagctgttcttttaatgtgttgtatctaactttcagattaaagatgtcttttgaatcgaagttattattggctgtgatttcgtagcaattaatgaaactctcattcccatcgaaagtaattaacgcaggtgtagttgcgatgtagtcaccacgtatgttgtaatcatttcgtgtatctggtgctgataattctgaactatataaaattactggctcttccctgactgaagagtttagaagaaatttgaagaaaaatatatcttttttaaaaatgtcttccactgaaacagacagttgtaaataacattgaatgcggaccttcttggtctcaccaaaggtgccttgatcattttttttggtgaaggatgttttaattattaagtcgaaggcggttatttggtctaacagatagtactccagcctaacgttctcgaatggagtattatatcgcttccttgcctgaatttcatccatggaaaaactaacaggtaaatttttcatgtttccaatatttttttgcacctcaacctctacttgcaaagattctaaagcgtcagattgcacgcttgtcaattcaagtgcatactctcccaagtttaaattatgcgcctgcttcaccagaaccttagtactttccttacaatatatttctggcactacaataaactcatcttgattctccggaaactcctttacaaaagtaatcccctcaacaatgatttcgaaagaaagcagagaaaattcaccgtacatgatatctctacactccaatattagtttattttcacctttcttcaaaagaaaatcactggcttcaaaaactatcacgtctccccccatatttttcaaagataatctcattgtttttgtactgatatcctccggaaatccgtagcttttcaagttaacttcaatagcgctaacattcgctcttgccagatgaactttagaattcaaagttacttcgaatagcccatctaagggatacattagatggatgttatttttcatttgtaagtccatgaactttttccaccaaatttccttgctatcgttatctttgcataacttaagtatattgagaaatgcattagttaaaacggccgatgcagaaactgattccccatcaatctgtaagacgtctaatttggggcagtggctcaaggaatcaatgaaaacttgcaatattttcaaaccaatgctattccagttcgtttgagtataatattcgtaacaggaaaggaaaagcgagactgcctcctcatatttctttccctgatagtaaagcaaacctatctcaatggataaaatatctactatcctttgacgcttcccttcacatttgttgaagagagaaagaatttctttggtgagaataaggaagttttcctggaagacagtttcatcaacacaagtttcttttaatagatcaaatttgtatttaacgtcactattagggtagtttttgtccattagtctataaccacttgtagccataacaccttgcacccagttgtcgcgcttcaacattaataactcagctttgatttcacacaagagaggatttgagacattctcaaattcaaaatatgacagcatcgaagttataaaatagtgcttaaattccaataatctcacagactttctatattctattgatatggattcaataaaattcttgattagttgaaatgctcctacaaaggcggtcaacgtctggtcctctagttttagaagtcttaaccttctaatgaaaaaatacttatgcaattggaacttatcaagtgtaccttctattattatggagcccagagattcatctgatttagaagatgattcaaaaggtacctgaagttttccatccggcatattcatgtttctacggagtatttcttttttgattttttgcaattccaggctggcatcttccaaaatattgaataccacatataactcgtacaatttttctcttgtcaaaagctgttcctcaaagttatttcctttttgtaaattggccaacgaatgtcgcaaatgtgtcaatcgtttttgaaagatgctcagtacggaggctttaatctgttggctaaattggttccaaaactcctgcctgtctttgggagatctataaaccgatcgaacttccaaagtttgtacatgcggaaagtctttgccaaatttctccattagggataccgatttgaataggttagagtccactacttcagaattggcatacagtaaaataattggtttataaatcattttttctcctgtcgatgaagatacagattccagatttggtagccactgtctcacaagaggccgtactttggccctgtattggtcgatagagatacagttcactatcaaaaatctgataaacggctgttcatcattagacttgtctgcctcccctctaccttctggaatcaattcaattggaagcctgttaaccgttcgtacagttccgtcaaatgccttccaatgtatattgtctaacggtaaaatctgctgaaactctggcctcagactctcaaataaatcaaacgggtcaaaatagctgacaggaaccgatccacaatatatttctttatccatctactatattagcatgtaaaagcaagttcactggctatttttactgcctttatgctcactttctttcaaaacttctaacttgcacttttcaccattttcatgttccgcgagctgttcttaagaagtgaaaacaaaggaatttgaaatgcgagaaagtctttagtcctattgacaagtatattgaacacgttgtaaattcaccaaggggttaagtacaagaatcaataaatctatactgtgaaaatatgtcaaaaaaaaaagaaacctttactccaagggcaaataaacttaatctgacgaccccaagaagaaaactgaaaatactgtcatctctccttgacgcggacgaggattccaaaatgaaagatcaacatgggtactcaagggtccacagtgataaatacagagtagcaaagcctactcagcactcgactttacatgaatctatttcctccaggcgaagcagtcatattcataataaatcccttcatgaagatagcgcgagggcattaagctgggtagattctctaattaatagggggaaaagtatacttactacactagaaaaggaagatgccttgtttgagcgtagtcttgaggaggaaagacaacgttttcagcttcatgactctttaatgaacaagtacacaggaaacagtaaatctcatcagcgactaatcgatctcaggaagagccaatacggaacggatacttctttccaaaataatgatgaaatccccttagatagtttcataagttctcccttaccggacgctgaggacgagtcgtcctcaaatatcgactccgataaggatgaagatctggaaggtaaacaatctttaatcaaagatttcgatcttgaaaatgatgaatacgagctctctgaagaagaaaagaatagtgacggccaaagtagtccttcaataatgatattatcagatgaagaatacgcagaggaaggagcgctacaagatgtatcgaatgatgaatatgccgaagaggaggggcaagttgagagaaagaatatagagcaagaacaggcaaatgtagagaatgctacacaaattagttcttctgattccagtgaaggacggaattattcagagggagtagaaatggaattagaagacgacattgatgtggaaagcgatgctgaaaaagatgaaagtcaggatgaagaaggaacagaacattcggtagatttttcaaaatacatgcagcctagaacagataataccaagacccccgttatcgaaaaatatgaatctgatgagcaccaagtccatcaaggatattcagaagacggtgcatttgatttcggttcagtaaatatttcagttgacgatgagtccgaagatgatgaaagtcaagccgaaagttactcagcaaatgctgaaaatgtgtaccaccataatgaacatgaactggatgataaggaactaatagaaaatatagaatcttcagatagtgaatcccaaagtgcacaagaaagcgaacaaggaagtgaagatgattttgaatataaaatgaaaaacgaaaaaagcacgtcagaagaaactgaaaataccagcgaaagcagagaccaaggtttcgctaaagatgcttatactaagaacaaagtggaacagcaggaaaatgacgaagaacctgaaaaagatgacattatcagaagctctctagacaaaaattttcacggaaacaacaacaaaagtgaatactcggaaaatgttttggagaatgaaactgatcctgctatagtagaaagagaaaaccaaattaacaatgttgaaggttatgacgtaacaggaaaaagtgtcgaaagtgatttgcacgagcattcccctgataatttgtatgatctcgccgcaagggctatgcttcaattccaacaaagtagaaattcgaactgccctcaaaaagaggagcaggtatccgaatcttatttagggcactcaaatggaagcaacttatcgggcaggtctttagacgaattcgaagagcaaatacccctaaaggacttcacaggtgaaaacaataataatttaaaaacagaccgaggtgatctttcatcttctgttgaaatagaggttgaaaaagtttctgaaaagaaactggacggttctacagaaaaagaactggtaccactatccacagatactgcgattaacaattcatcattaggaaatgaagacagtatctattattcactcgatgacgctgatgctatatcagagaatcttacggatgttcctcttatggaaatcaaaacaactccgaaatatgaagtagtaatttctgaatctgtgtatagttctacttcttacgaagataacgcagttgccatgccaccgcaagtggagtacacttcaccctttatgaatgacccattcaattcgttgaacgatgattacgaaaagaagcatgacctactgaaatcaacgttagcagcccttgctccagctttcaccaaaaaggatgcaaaatttgtggaagctggagtgacgaaatcatgcttgacatctacatctgggcacacaaacatttttcacacaagtaaggaaactaaacaggtgagcgatttggatgaatctacggaaaacgttacttttgaaaatgaaaatacagatgatgaaaataaaaatcaaagtaaaaattttccagccgtggctaacagtactgacaagtcaactgaagataacacggatgaaaagtacttttcagcgattaattataccaacgttacaggagactcttcctgcgaggacataattgaaacggcttcaaatgtagaagaaaatttaagatactgtgaaaaggatatgaacgaagctgagatgtcttctggcgatgaacgcgtaaaacagaatgatgatggcagtaaaactcaaatttcgttttcaacagattcgccagacaattttcaagaaagtaacgacaacactgaattctcttctactaaatataaagtaagagatagtgatcttgaagacgacgaatcactcaagaaggaacttacaaaagctgaagtagttgataagcttgatgaagagaacagtgaggattcatatgaacaagattatgcggatccagaaccaagcaatgatgaaggcagtaatgaaaatatagttaaaggtacaaaaaaggatactcttggaatagtagaaccagaaaatgaaaaatttaataaggtgcacgaagaagaaacactttttgaagccaatgtcagttcatccgtaaatgttcaggacagagacatgcacaccgacgtcatcaatcaagaggcgcaagcgaattacgaagctggtgaaagaaaatactatatccagaatacagatacggaggaagcacacatttccattatcgaaagaatagatgagaatgtgattggaaataatatggagatcctagaaaggtcgtgcgtggaaaaaacgcacaacgaagtgctctttgaaagaagagcaactaccattgaaaacacaaaagccctggaaaacaataccaatatgcatgatcaagttagccaagcttgctctgattcagaccgagaccaagactccacagctgaaaaaaatgttgagggatctgcaaaacataatttggacattcgggtgtccagttcggaaattgagtctgtggaaccattgaagccagaatctgatcgatcaaatattttttcatccccaattcgtgttattggagctgtagttaagggagtgggtaaggtagtcgacgtagctgaatcattcgtgaaaaaaattgatgttatggattctgagagtgatgataacgttgatattggtgattataatcaagacatttttaacaagtcgaattctaccgatgcatctgttaatatgaaaagtgcaagtagcaaagagagagacagcgatgaagatgaagctgtcatactcggaggagttaccgcagaagcacataatgacaatggtaataattctcatgtgataaacatcgatcccacgacaaacggtgctaatgaagaggactccgacgtgtttcgacagcaagtaaaggacaaggaaaatttgcataagtcggaagagccgctagttgaatgtttacaatccgagcaacatttcgaaaagaaagaccacagcgagaatgaagaagaatgtgataccatatatggagatataacatcagcaaatattcacagtaatgcccccgatgatattaagagacaacaactcctaaagaatctaagtgacctagagaattattctcagaggctcactgaagattccaggagaggaaaaaatcaagaagaatcagacgaagttaatacaagccgtgaacgggatctcacgtttgaaaagtccgttaatgagaaatatgctggagcaattgaagaagacactttttcggagttagatattagcattcaacaccccgaacatgaagaagacctggacctatcaaacaatcaggagaggtcaatagaagaactaaattcagagccagaagaagctgagttgtacgaattggaaatagagggccctacagagacagcagcttctagtaaaatgaatgatgatgaaaggcaacgcggaaatataccgtccacagatcttccatctgatcctccgtctgataaggaagaagtgacaggttcttatccctattcaaattcggaaaatattaccgctgaaaagagtgcgccaacatcaccagaagtgtatgaaatattctcagacacgccaaatgaagtccctatggaaattaatgatgaaattcccgccaccacgcttgagaaacacgataaaaccaatgtaacatccgttttggatgatagatcagaacatttatctagccacgatgttgataatgagccacacgataattccattaacatcaaagtaaatgaaggtgaggagcccgaacatcaagcagtggatatacctgttaaagtagaagttaaagaagaacaggaggaaatgccttcaaaatctgtacttgaagaacagaaaccaagtatggaactaatcaatgataaaggttctccagaaaataataatgatgaggaaacaaaccgcgaaaaggacaaaactaaagcaaaaaagaaaagccgtaaaagaaactacaacagcagaagacggaaaagaaaaatcacagaagacagttctgccgcatcaaatactaaaaggcgtagggggcacgagccaaaaagccgtggacagaatacgcatccaagtgttgacaaataatcaaattgtatacaggaatatgtagatagtaataattattgcgatgcgtttttctatacgagatctaaaaggaaaaaagttcggttttaaggcggagttaacgtcatgtcgaatggaaagaaagattatataaagaatggaaaaacaaaaaaggtgaaaaagcatcttggaaggcctcataataaatcaatcggctgcctcgagaaatgtcagagttgagagccttcagtgccccagggaaagcgttactagctggtggatatttagttttagatccgaaatatgaagcatttgtagtcggattatcggcaagaatgcatgctgtagcccatccttacggttcattgcaagagtctgataagtttgaagtgcgtgtgaaaagtaaacaatttaaagatggggagtggctgtaccatataagtcctaaaactggcttcattcctgtttcgataggcggatctaagaaccctttcattgaaaaagttatcgctaacgtatttagctactttaagcctaacatggacgactactgcaatagaaacttgttcgttattgatattttctctgatgatgcctaccattctcaggaggacagcgttaccgaacatcgtggcaacagaagattgagttttcattcgcacagaattgaagaagttcccaaaacagggctgggctcctcggcaggtttagtcacagttttaactacagctttggcctccttttttgtatcggacctggaaaataatgtagacaaatatagagaagttattcataatttatcacaagttgctcattgtcaagctcagggtaaaattggaagcgggtttgatgtagcggcggcagcatatggatctatcagatatagaagattcccacccgcattaatctctaatttgccagatattggaagtgctacttacggcagtaaactggcgcatttggttaatgaagaagactggaatataacgattaaaagtaaccatttaccttcgggattaactttatggatgggcgatattaagaatggttcagaaacagtaaaactggtccagaaggtaaaaaattggtatgattcgcatatgccggaaagcttgaaaatatatacagaactcgatcatgcaaattctagatttatggatggactatctaaactagatcgcttacacgagactcatgacgattacagcgatcagatatttgagtctcttgagaggaatgactgtacctgtcaaaagtatcctgagatcacagaagttagagatgcagttgccacaattagacgttcctttagaaaaataactaaagaatctggtgccgatatcgaacctcccgtacaaactagcttattggatgattgccagaccttaaaaggagttcttacttgcttaatacctggtgctggtggttatgacgccattgcagtgattgctaagcaagatgttgatcttagggctcaaaccgctgatgacaaaagattttctaaggttcaatggctggatgtaactcaggctgactggggtgttaggaaagaaaaagatccggaaacttatcttgataaataacttaaggtagataatagtggtccatgtgacatctttataaatgtgaagtttgaagtgaccgcgcttaacatctaaccattcatcttccgatagtacttgaaattgttcctttcggcggcatgataaaattcgtttaatgggtacaagctatacatactaggatgaggatggtactgagaacgataaataaactttctagatatataactttatgtcatttaaatataaataaagtgcgtggtagcttgaaagtgtgcactcagatagtttggtagttggaggacaatcctctttcattcacgggcttgtgcaaaatctgagatcgtatgtaaaatgttaaagttagtgaaaaaacgactgtgaggattaccagtgtaaggtttattgggaatggattcatgttgaaagtagtatgtgtccatttgtccagtaagttttgactcatgttgaaaataccacaaatgcaggacaataacccataaacagtaccaaatgtgtcaaatccaaaaacttttgaagaataatcagaaacaactgtgtaataaaatggtctgtacactaccagaagtactatacctattaagttccaagtgaatgaatttggaatcaagccaaaaacacctatagcggtagaagtggtgaacaatattgtgagagtggacaaagtatctgtatggtccaagagcagcccaataaatggtatggaaacagcaccgccaagtggaagtaacatatcaaaaatggaattcaattttagtgctaaatcaggatcatttaataagtattcttcttgtgttctgacggtagcaataaaatagtttatcctcagcatggcaacaagcgcaaataaaagcattaaataaaaccacggactctttatttgttcataagcggatttcccatgcaagactccgaatatgccgcctgactttttctgcaacttatcttcaacgtaagtttccaataccgatttccttctctgcggccttgatgggatactatcttcttcacgctcgattgcaatcaacgattgacgttcctgttcatcagggatgataccggagcctgtatcaccctcgatgagtcttccgttttcatctaaaccttccacagcgatcttagcaatgtgattgacagttttgtaggaagaatgaggcattatcgtgagttgacaggcaagaataaacactggaacaatcaaatatagggtgaaaaatctggaaacgttcaaggtaggaaaccagttttgatataacaacctatataacagaaacagcgcagatgacgaatcaaatgatcctgttagtagggccaatacggttcctgatctttgtgggaagctatttgccaattgaaaacatgaaatgaagacgaacggaccggcaactgccaaaagcgtgtaaccgacaagatatgggtcccaaagagacactagatgcttggcagaaataaaattaccgcttgctaggaacaagagacatgatcctattattccgcagacacgaggtccatacatatccaaaatcttaccgacaggaagggccatgatgtttgttacagtagcactgagagcaaatataaaattcaatttcagatcctgtgcagtacataataatctatcaccatccttaggatcacacaattcatggtatacaccttctgaaattaaaataggtttcaaagcagcaaatccaaagataataccagctgaaaaaagacaccagatacaagcacaggcaacctgtgcgtatctcaacgttcttgtactggtcattacagtctttactgccctaatactggcctaacgaggaataaaatcatttatagatgccattgttatcgttatcataatgaagcatcgtatcggtagttaagttaatttgacgtattattacccggaggatttaatcatgtataattatgtatgtgaagattatgtgaagattacgtgctatatatacttgcctcaggccaactgctggagccattgagccacttttctcacaaaccctcttgagttcggcacaaagtggcccccagagtgcattagtaaagtgcgagagtcttccgtacaagagttatataggccttgcactttggctggctctgtgatagtgtcaagttctccttgaacatgtagagatgggaccgatattggatgcaggtcgtactgttcttgatactgttgtggttggaacnnnnnnnnnnnnnnnnnnnnnnnnnnnnnnnnnnnnnnnnnnnncccccccccgccatgaaaaattctagcggcggctgttcttctgctgtaaggcccaacaaaccattgaaatccgttgccaggtatccagctacaccagctccttgactaaatcctacaatacctgcaaatggaccattttcaaggacataattgtgtaaatagtcgattgtcgtctgcggtatgaaatagccaccggtggaagggtcattctctagccacgcaagcacaccggtattctcaccatccccaggtgcatcagcaattacctcacccaagaaatcaggaacatcagctgggggaaattcattgggtgctgttggatagtagagtttatatcctaacttttccatttcggcgcgaaacccctttgtcttagaggcaaagtagtcacctgactgcgcaagcccatgtaacatcaatacattcttcgtcatggttacaactattaaatcttatagtcttgtagcattgcacattctttcttcacttataccttttttttcttctctactcttcctttttttgcttttctttgaatttttcaagtgaaaaaaaatcctcgattatagtgtgtaaaaagcatcaataatttatattgtatatgggctagaaagctgttgtaatagcaaagggattatattagtggacctgattaattctaaaaatatattttacggataataataaaggttttcttttgagaccagttagtccatttctttcaactggctgtcataattttgaatactatttattgatcggatcaaaagggaaaactacagcttcggtcctcgtcgtcctacttgaaaccctgctttttttatttgttattaataattatgagcatttgtccacatatacagcaagtatttcagaatgaaaagtctaaagatggggttctaaaaacatgcaatgctgccaggtatatattaaatcattccgtacccaaggaaaaattcttaaacaccatgaaatgtggtacatgccacgaaataaactctggtgcaactttcatgtgtctacaatgtggattttgtggatgttggaaccattcgcattttctctctcacagtaaacagattggtcacatatttggtatcaactcaaataatggccttttattttgcttcaaatgtgaggactatatagggaatatcgatctgattaacgatgctatcctagcgaagtattgggacgacgtgtgcacaaagaccatggttcctagcatggaaagaagagatgggctttctggcctgatcaacatgggatccacttgtttcatgagtagtattctccaatgtctaatccataacccttactttattaggcactcaatgagtcaaattcattctaataattgtaaagtgcgttctccagataaatgtttttcatgtgcactcgataaaattgttcatgaactttatggagcgctgaatacaaagcaagcttcttcgtcatctacatctactaatcggcaaaccggattcatatatcttttaacttgtgcctggaaaatcaatcaaaatctagcagggtattcacaacaagatgctcatgaattttggcagtttataattaaccaaatccaccaaagctatgttcttgatttgccaaatgccaaggaagtcagcagagcaaataataagcagtgtgaatgcatagtgcatactgtgtttgagggctccttggaaagttctattgtgtgtccaggctgtcaaaataattcaaagacaaccattgatccattcttggatctttctctggatatcaaggataagaaaaaactttatgaatgtcttgacagtttccataaaaaagaacagttgaaggatttcaactatcattgtggggagtgtaacagcactcaagatgcaataaagcaactaggcatacacaaattaccatcggttttggttttgcaattgaaaagattcgaacacctacttaatggaagtaacagaaaactagacgattttattgaatttccaacttatttaaatatgaaaaattactgttcaacgaaggaaaaagataagcattctgaaaatggcaaggttccagacattatttacgaattaatcggtattgtttcccacaaggggacggttaatgagggacattatattgcattttgtaaaatttctggagggcaatggtttaaattcaatgattccatggtctcctctatatctcaagaagaggttttaaaggaacaggcatatttattattctacaccattcgtcaagtaaattgattcagcaaatagcattcaacaataataataaaacaaaaaagaagaaaaagctatgcatattcctatcacagttaacgcttgcttccgttcttttttctatatcatcgtttccatcatgtttttctttaaattgaatactttcctatgctcttaatgagttgcgattgtgcatatactgtatttcaaaatcctttgtatctaactaaggaagaaaattactatgacgtttattcaggatttttttttttcattccttgctatacgaacaaaagagcaaaggctggaaaactaagtgagtttatatatagtaataattaaagaacatatcattatcatgaatttagaatgcaaatttgctcctctcaaaatggcataccttgttgttcgcgaaggcaagcccttggttataaataggatataatataatatagggatcaagtacaactattttcttttcttagcaaggagacttccaagaatatccgtctttggcgtccttgatgctcttccttttccccttctggaagcggttttggtgctcgcagcaggacgagtctttgtttttgtttttcgaccattaagtaaaccataactagcgtcctcttcgtcagtactgaccataattatgtcattctcatcaatatcaacatcatcttgagcatcgttattatcaccgagttcattttctgcatcggatatgacagttgagtctgaaaaagcaggaattttctttttcgttgcagttcgcactcgtttgggtttgctcgttggcttactgctttccgcttgactaatatgggttattcttgattcattatcaacatgtgattgggtaatgtctggagatccagttcttacttctctattactagaccggaaggaatctagcccattaccattgaatgcgaaatttgtctcatcattttctttagggggagtcggcctaacactgttagcacgcttaacctgttttataagcgctttcatttcctctgcatcatctgttctcagaaattcttcattcgtagataatattccaacttcgttcgatatttcatggctaataaattctttaagagctgttttctcatctttatctacaaacttctttactgcttcattcaaaccaacttctggtaataaagatagttgcattttgttcaagagatcattaaccaaagtttgaacttctagttcaccgccactttcgctgaaaagtttctcaacatctctatcactgatgcttgttccatttataccggatttttttgatctagttacaggtgacctttttttataaaactgcacaacgttattaccgttagcaacacgtcccacaaatcgattgctaaatctacgcgggttttcaacttggtaatctattggggattgtgtattggagggtgcactataatcaacacgtaatctgatcaatggtttcggtaattccgcaaccatgtcaccttcaccatcgtccgctaatttttgtttagtttcctcattagcgtcgcggatcatttcttcaacttgttcaataagatacttagacgtagcatctttatcgtgaggcctcaaatggggaacatcttgtaacgaaatggatttcattttgaatgtccgtatagtctcaagaggaataggtgtcatttttggtgcttctccatactttatgtcaaggataaagacatacttgggttgtgcctcagcctcacaaagtgaagtagctacagatgaacctggttgtaatacatcaaaatttttaattggattgtgtacgagattcggaatacactcatgttcatgaccccatatcaccatatccaggaaatctggcaagaactgttcaggtaaaaatgcagtattcgtgtgacctgtatgattttgatggacgcacattaaattaaaccattcaccttctcgcatagtcggtacttcaaaagtgacaccaccatccttaaaagttctaaataacctttcatcacgaacagcggctaatccgtacaatgctaacttagtggaccctttctgaaataataatggcacgacttttattttatcagattcgatgactttcccgaaatgatttattagaccagtcgcatgaagtatatccataggacacaacagtgagtcccccgacgcatcatcatgattacctgatatgccgaatacgggaatagaaatattaaagttggggtcctcatagttaacgttggtaaattcatcgtagtgaaaaacttgtgagggatcgctcaataattctaactcgcaaggcttgtcacccatgcaacataatctcaaagtcttcagtacttggtagagtgacttcttggaaggcttattcacgtgaaaaagatcaccggactgtacaaccatgtctacgttgttatttttggccagcatcatgacttcatggaaagttttccaagaatcatcgccagtaatgggatcattttcgttgtaacccacatgattatctgtagtaattaaaatccttattgtgtctggatcaggatagtccatagtcgagttttatcggatctgagcaggtacaacttgcgtcaattgtctgcattctcttaatgttgtttccacattgtcttccttacaagcgtaaagagtaatttaatatggctataatgtttgggttctattcgattggccatactatttaaaccttaagtcagtttggttgggtatatctatctatacgtttgtgtaattgcatatatattatttacaggcttgcttgtgaactctgactttgtttttgttagaatattagaaacgtgcatgcctacaatgagatttgtagatgcctttattttctcaatgcatttccaacatatgtttgagatccagctgtttcgagtgacggtcgaaatgattggctaattcctgaaagttcatgtttgatggatcgacttccatttcttttttgtccttgtaggttactttcacaagaggcttgactttattgtaatctgagataatttccgattgaatctgcgtgcccatgtttcgttgcgttggtggaatggcagcaagtactaacctagcaactttcgctgaaatcaatgatatgaccatatcatttgctgttagtatttgtgatagatcggttcgagcctacctcagcctagtttagccaaatctttaaatcatgatggccaaaggtaaggagaacgaataacagagcgaaaaaaaatacataccttccttgccaaagggattaaacctgacaattaccttactgaagtatttagttatcatggcgaagatataattaagctcgtttcttcttcacatctgttcatcctctatttgaggatccataagtttatctcttttatttcgccggtatattccgtagaatcgcgcaaaacggttcagggaagaatgaaatagctaaaaagtcttacatgtataaaaagtatacagatttacttagtttagctaggtttatccacggaagatatgatgaggtgacgcttggtttgttggaaagattaaagtgtctgcaattacagtattttgttttctggaagttgcatagacgatcagatcagccacgtcatcagccatcaatggggtagtatccttgtaaacattcttggcttgttcctcgttacctctgtatctaactagtgaaaattcagtctcgactagccctggtgcaattagaatgactctaattttagtgttgatgagctcctttctcaaactatcagtgaacgcccccacggcaaacttagaggcacaatagatagaacctgttgggtatgcgtctctgccagcgattgaacccaaatttacaatatctcctgaattcttggcttggaatatgggcagtacagcttgtgtgatattgattaaagccgtgacgttggtgtcaaacacgtcctggatatcctccgttgcgatctggcccacacggtcactgccaagagcctttccggcattgttcaccagaatgtcaatatccttgaactcttgtggcaagttttcaatgaagggcttgattttttctgcttgagtgatatccagctgggccacatgaacttttgcgtttggaaactcttgatcaatggtcttcttcaattcctcgagcttttctaatcttctagcagccaagatcagtttcatatcaccattggatgcctccaagtactctaatgcggtcgccttaccaataccagcagatgcacctgtaatgaggacagtcttcttagccaatctttctgcagcttttctaccttgggacattatcaaaatacgttctcaatgttctatttcccgcctttactagtgagcttgaacactttctatgcgccatgctgtttcatctatcctcctttcttcagctttttatatcgctccgataagaaaaatcggtgtcgtgccttaatatatatcaatgctatacgtcatagagtagagtcgtatagtgtataagagtaatatatagatgataaagagaacttactcatcaccctctgcaccaaatagcatcatcatatcgagatcgttctggtcgagtgtttcctctgcgggggcttcatcaagttcgcgcaccaccttgttctcttgtatgtgttcccgttcatgcacattatcctcgtcctcatcgttttcttcgtcatcctcctcgtcttcgtccacttcatcctcttcctcttcttcttcctcttcctcttcttcttcctcgacgttatttgcagtttctgcgtcagagcgatgttgatgttgtttctggacagaatcttcggtttgttgtaactgcttacgttttagttcagcctccttctcgagctttttaatgctatctatgaacctgcttttcaaaagaggattcgtggctttacttaatttatgcttggtatgggccagggtggtctctagttcgttcaattcgtccgcaagtaattcagtgtgctgtctgttttcgtctttttcgtcatcagattcactttccccaccagcagcttcaatgtcaccgtcgtcatcatcgtcatcatcttctccgcctgtgtcttgatccacctcatcaccgacttcctcttgttgttgctccttgtctccctcggcaccgctaccttcctcttcactttcaaaagcagcgcctaggtcaagatcctcctcttcttcttcttccattccttcttctccctcttcttctgcaccttgttttcctactgccgaagcaattgtgtgtatctcttctttctttaaagcaggtctagataaaggctctccaggctcctctttgaaattttcccaactagaaacacgctcttgcctcgcttgcagttcacttttatcaaccagatcatagctgacctcttctgcctgtttatcttgcttcaaaagcatatcaaccactttttctacatagtctatttcattagggtccattttccgtctaaatcgtctatttcgaacattgtacaaaggtggtgatattccatgtttgtagtcatagcccttcaaagctatttctttcaaatgtttagcctccatatcacttaaaggcgcaccattgtatccttttaagaaggtttctttattctcccaaatttcatcctctatgccttcaaaatgcttaacaaccagatcttctgtatcaggggcttctagggcatatacttcttcctcttcttgtataggtcttatgcatagtagcatttgtgatacgtcaaatgtcttcaggaggttttttctatcgacgctcttgttcacttctataactgtaggcaaatctactagaatggcaccatacattacatcgtttattgttacgacagcgtgtctctcgtttttccacttgatacttatcccagaataatcacctgattctaacgaattttttacaaactctaactgtatgtctggaagtatccttaatatcacaccactctctatgagagggtcatcttcaatatcagaggcttctgagtcgtacgcttccccaggaattctaataggtttgagacgtagctttggcgccttgtgtatcttcttaactggttcttcattttttttcaagtttaactttaacttcaatgaattcttcttctctttgccgtcagcactctctttctttttctttaggtttatctttaatttaggctttggtttgatatcttcatcagttacctttgtctttatgcgaattctctttagtttaggctcgccttctaatggttgatccttctctcctggtcctctgggttttttaattcttataacagccatatttacgtcgattattgcgactaatttgaatggtaacactgtctcttgtttatgtagttcttcctattcttctcgcttttattatttttgctagcaagttttgtcttgaaattttatttactgttctcatcggccgaataacagcgatattattgtatgatgataatagagatgaaactttacaaatgcggttactacgtcagtcaataccattctttgaagtaagaaggctcagcaactatgtctgttccaatccctggtattaaagatatctccaaacttaagttcttttatggtttcaaatatttatggaatccaacagtatacaataaaatctttgataagctggatttaactaaaacgtataaacatccagaagaattgaaagtacttgacctctaccctggtgttggtatacaatcagctattttttataataaatattgccccaggcaatattctttattagaaaaacgctcaagtctctacaagtttctgaatgcaaaattcgaagggtctccattgcaaattctaaaaagagatccatatgactggtcaacctactcgaatctaattgacgaagagcgaatatttgttcctgaagttcaatcctcagatcatattaatgataaatttctaaccgttgctaatgtgacgggggagggttctgaaggtcttataatgcagtggctgtcctgtattggaaacaagaactggttgtataggtttggtaaagtaaagatgttattatggatgccaagcacaacagctagaaaacttctagctaggccaggcatgcattctagatccaaatgttcagtagtaagggaggcatttacagatactaaactcattgccatatcagacgcaaatgaattgaagggatttgatagtcaatgcatagaagaatgggatcccattttatttagtgctgcggaaatatggcctacaaagggaaagccaattgcgttagtagaaatggacccaattgacttcgattttgacgtagataattgggattatgtcacgaggcacttaatgattttgaaaagaacacccttgaatactgtcatggactcgctgggacatggtggccaacaatattttaatagtagaatcactgacaaagatctgctaaaaaagtgtccgattgatttgacaaatgacgagtttatatatctaacgaaattattcatggagtggcctttcaaaccagatattttaatggattttgttgatatgtatcaaacagagcactctggttgaaaaaagtgcttttaaaatttacttcattatttaataaatatgtgattttagcgtgtgaatataaaaaatacatagaactcaatcttcgttaacacggaaccatcttgtaatcaagaagcgagaagcggaactaaaactttaagaaaaggagctctacgaaccgtcaaagctaaattgatcgatagaaattgcttcttgaaactttacattctatgtactttacaaatatactttacaaacttagccatttatattactttacagttaaaaatccatcaggaattattcgtctgctttttgagattcatggctagcgacatactcagtagctttagctttaacgtattcaatggtcttttcgtcaccttcagattcctcaaattgtaaccatttattaaagaaaaacttagcctgcttccttgttatttttttggttattattctctcaaataaatcttccaccttcttcttatcttttgccttcacttcctggtctacgtaaacgttccacaggtcaattctctttggcgcatcagcaaccaaaccttcgaataatgaccgacccctttctgggtcaccctttgcaaattctaattgagcaaacttgcggacaacctcgatatgattacgctttggtagggccttcaaagcattacctaaaatagtacgtgcctcttgctcttcattgtggctgatcaaaaaatcaccccacgatacccagatagaaactttctcgccgccaaatttcttagctgtagctttgaataattctgctgctttgtcgaacttttcacttatttcataaataccaagcagttttgtatgaatagtatatgagtccatatactgacaagccctgctaaacacttcttctaaagtttcttcggtaccaaaagtattttctaaattcagcattgcaatccaaatattcaacttctcggcttcttctctgaagttgatggtctttagcgcacgttctgcgagctctcgagccttctcgatctcactcagttgtagttggaaagccatatagttcatccacactacggacgaatttggattaccgataagtagacgttcaaaatcggcaacagattctggtgccctagtgttgatatcaatggtcttatcctgaacaacattttcctttcttctcttgtgcttgtgtttcttattttcagtaaagtcttcttgatcttggtcagactcttcttcttcttgcgcttgatccaaaatggaagcagtccaatcaaaaccagcactcaaggatagcccatccgaagatgtttcaggcttcctatcggcaacttcggtgttttggtctccgatatcagattcgctgtcggaatcgttgaagccagcatctgccatgacttcatcttcatcctccttttccagttgatccacagtagtagtggtggtggtagtagaagccaattcggcttctttagagaaatgagacgctttcaagctcaatgaaatttgttttttttctggatttgttttcaaaacaatagcttttactctgtccccaacaccaaacaaggcagaaagatcttcaggttttttgtccgcaatttcagtaatatgtgccaaaccagtaacattaacagtgttatctagtttgacgaaaacaccaaaatcagtgacgcttttaattgtaccctcgaaaacatcaccagccttaatgtctgaataggtctttagaacctttaaatcaccatttatttcggattctcttagggttagagaaatacgagaatcttcatcgcatgtaacgacttttcccaaaacgtattgcataggcttgtaaaacttcttccattccttcaagtaagaatcagatagtttactaacagggacaaaggcttcaactttcctactcaagtaaacaaaaatacctttgtcattcacattcttaacaataccatctacaatctcgccttgcttcaaatcttcatgagatttgatcgaacgagtttttgcagtagcaggacgaagggatagttcaattttcttattctgttcatcaacagataaaacggtagttggaatgacgttgttaattttgtcttcaaaagcttccttcaatgttagggagaaatcatttaacgcatccgtaataaaggaaataccagtcactttgttaccaaggtctaacaaaacatacttttcagctatttttagaacacgacctggcaattcatcaccaactttaattgtggacatatttatgtcaacatgactctttccaatggcattgacaaagccatgctcgcggtcaatagaggcaactttcacttggagggctgaacctaatgggaaaacagattcaatattttctgaaaaatttgaatcgttatcagctaaatctagtagagaaattctcgccttcaaaactggagaaattgttagccataggtggttacctgatgaattgttgacaaagccagttaactcttgcccaatgttgatttcctcaagactttttgtgtgcacttccttagattttaattctgatggtttcatggataattccaaaacgctagcctttgagattttgtgtgtaatcggcaagaacttatggctcttgacatcgtgattacctatgatttttaccttgatgacatcgtcttttttgtaattactcaacggctgtttcttatctgtaatttcttcatacgtgtcaaacacttcagcaatgtccactctgccatgcaaatttgccgctaaaataacattcaattgatttttcttgacgctcttgatttttgctttaacaatactaccaatagacaaatcgtcccagcttttgatagacgaatcaacaggatcttcgatattagattcaactttcttcttctcttctttgacctttggagcttttagagataataggaatttctggtttttgtcgtctgttcttaataaatagacggtaacggattggttaatataaaacgccttgctgatatcaatatccctactatcaacagcgtaacttggtaaaaccaacccaatgaacttaccgttaaatgcaacaaagagacccttatcagaaatggatttaatgtaagcgtgcattggtacatctttatttagatccttaacatcatcatatgttaatggaagagtctcctttttagcgtctttaatcagagaacttttgagggacatattgaaaacgcgggttcttgtatctttatcaattaccaaaccagtcagttcagtgccgattctgagctttttcaactgagccctattttgttcaattctggaatcagagagatgaccaacgtagatgacaccacgcaagccaacatcaggaatttcaacaataacagaatctttggttttttcgataacatggacagtaatgattgttctgcctggaacaatattttcaatggtatctttttgttgggcagcctgttcatttgaaactttgcatgtggcaataattctcctcctgtcagcatcgacgtcaagaagttttactattactgtttgaccgagtcttaaatgttcttctggtctcttcacaaagacttctgagatctcagaattaggtaaaaatcccgataaaccaccaaaaaaggaaatgatgcaaccatttggtttgaaaacttgaatagttgctaaagtcttttcatttttttctttgatatttttggcgttttcataagtggaaaccagtggtaattcgttgtcttcaatattaactaatgattttttcaaagtgacatgcacattacctcttgaattaactgatataactctacctttaaccttagaacctatcttgaacttcctttctggataaactagcctggtatctgaaatgtgtaatggtggaacagaagccttaaattgcccgttaaatatcttcaattcaatacctgaactagagacggaagttatttcacaacttggtaataattctccgattggaatatcatttgttcttagatactttaattttaggtattttggatcagtggacaattgataaatgtcatcaacagggctataaccaaggaccctggaacttaaattttctgaattttcaatttcaccaactcttgaagaatgtactttacctaatctatcatcatccaatgctaagtatagatattcggaatcacgccctttaatgctgcatgattcaaatgtgtagccgatagggaatgcatcaagaccttcagtagatctcaaagcgtcttctagttttaaaatgtgtggaaggtttgacaaaatcaagaccttgtcaccgcttttgttttctaaacaagcaataattcggcatctaatactagaaccaataacaaatttatgctttaaatcttcttcggaaaatgttcttaaatgtgatacgttgacaacaccggatactaacccaaaaactttaccggcaataccatttttagtgattgattcacacaataagtcgacgatttgaccagggataatggcatcaattgaggagatttgagtaattttgtttttcttgtccgaaaagtctgtatttacaacaattgatctgtcggattttttggtgatattacctaagaaaacagcccccggcaataatttttcaaaattgccaaaatccttcttagcaatgaaccctgtaaagcctggcagaccaacatctaaggtagcaccgtgatcctcgatggatttgaccgcgcattgaatagacgtggatttaaccaaatcttcatctgcgtatatgttgacggatgaaggttcgatggttaactctattctcttctttttggatttcttagttgatggttctaaagaggtattcttgatgacagagcatcttagccattgaccaatgtgaaagtaccttcttaaattaggtaattcattagatttatctaatttttcatcttcgtcgtcggacgattcgtattctgcatcttcaactttggattttttctcatcagcagcatcagtatcactatccatatcttcatccagatcttccaaaatcgaagtaaattcttctgagatatgtgttaggttcacataaccagaaattccgtctgtgaatgttatacataaatcttgtttagtgatagcagaaatctgaccaagcaaagaagagccattcttcaacgttttaaagttgacatgttcaattagtccagctctagcttcatcagagtttgctgatgaggcctcggaatctttagaagtggatttctttgttgtcttcttctttttcaagggtctacttgctggttcagatgctttgacactttcattaccaaataacacatcacttgcagcttcgttagcaacttgtttcagttctaaaggagtcaaagcagacgcaccaccccttggaaaagagacttcctcagtgttccttactaatgatgaggtagagggctgctttgtggagtcttccctcgaaagtggaaaatcttcatctctctttcttttggtggaagctaccatttttgcaacagtacaggtgtgttttttatattaaacggtccttgattcagactgtagtagtagatactaatagctttaaataaaaatgaatagacgaaccttactgagctttcttcagttgctgctaatgtatagaagggtttagctcatctcatcttaaaatttttcaaaatttttcggaatcagaaacgacttagatcactttgcacgcgggcattgaatgactggccaatgtagtgacaataaactctctaatggtgaaatatgtaccgcggcaacaagtaagtttacgtctactaataatttgttgaataaagtaagcccagaaacaagcatccatctggccagaataatgttttcctatatgtacttaccaattatgtagttgaaaaatcatacacaaataatagcactataaataacgagcaggatatttataaaagagtttaacaacagagttcaggattgaatattctcagtaactgcgtaatacatattgttgggatttacgttttttgccttaaaccctgtttaatatctgtttagcaaaatgaaaagcatatggaaacctcttacgcactggaattgatatgttttctattaattaggataaaccgctgaacaagaacctttttcatggcatatcaaactttttaacattggaaaattagagaataagctcaagagagagatgtactgaagtagttttttaccgccggatgaagtgtttcgcctgctgtttgtttcgaccctgtgtatatgaccatttaggtaaagccacttaatagccatcaaatattgatcgagttcatataaagctaaagagtaggaaatataccatcaatggtgagcacttatttttttttggatttagatgtgagacatactaaaaaaaagttgctatcaagcctataatttggctacgttgtcttccggtgtttttcaattgatttaagttacaacactcaaatctgggtaatttgatcttttttaataattattttagtgacatatagttcttagagttcgcagatttattttgtcattttttggatcggcgtcttataaaatcaagacataatacatccgcacatcgcgcatgtgtgggtgtatatgcccttttcacgatttttaagttgcgtctcaaaatagtttccgagttggaagcctgagtttttcaaaacaatataggaattaaaggtatacgtctttggatacatgttatttgaaatggggtagaactagcacaactgaaaccaagaaaacacagatcataactaaccgttcaagatgttgatgccaaagcaagaaagaaacaaaattcaccaatacttgtttcaaggtatgtttgcattttttaggtgaaatatgcagtgatatgctccgaaatggatagcaaagatgataaatgaaaatacaattaaattgaacttgaatatcattaaaagtggtagaaaaccgattgtttcaaaaagatctttgtggacaagtacggcagtgcatgaatccgaaagaaaagtgcaacctaagcagaattccattatttcacgcgtccatttttataatgtttgaacttttgagtccttatagaaatgctaatattatgatcaaagcgattatatcatttactttacagtttccggagtttccgtattattgcaaaaggaccacaaacaattgaaatcatgatatcgtaagaaatattattactaacaaggaagatcattgaattacgatcgcatatcgaaatagaaggtgttgtcgtcgctaagaaggatttcaaccaagctaagcacgaagaaattgataccaagaacttgtatgttatcaaggctttgcaatccttgacttctaagggttacgttaagactcaattctcatggcaatactactattacactttgactgaagaaggtgttgaatacttgagagaatacttgaacttgcctgaacacattgtcccaggtacctacattcaagaaagaaacccatcccaaagacctcaaagaagatactaagtgcgttgttacgtttaagtaaactattttctatttaatattagactattctttattttgttctctctcgtaatatatgtggttttatgcatcaaataagtttttatcactttatttccttttacaatgtgtattattgtaaaatactcacaatgtaatctattttttcaggatgtgttacgatgcagacatgttttgtgcatgctctttagcattgttgtgcattttagattgtcgtcgtttgtttctgtatgtggtgtacggattatgtgtaactgtattaattgttcaagattcattcataatattaactaatgatcccttcaagaacgcgccatatataaaatattcaaagttaaaccttccaaaaatcatagcgtttcatctataggcacagcaaatcatgtccctgagctcctggaggcaattccagcttttcgagaatattcccataagagatcctaattttggaggagattccctattgtactcggacccaacactttgcgcagctacaatagtagatcctcaaactctgatcatagctgtaaattcaaatattataaaagttgtcaaattaaatcaatcgcaagtaatacatgaatttcaatcttttcctcatgattttcaaatcactttcctgaaagtcatcaacggggaatttctcgtagcgttagctgaatccattggcaaaccttccctaataagagtatataaactagaaaaactgccaaatagagaacaactataccattcacaagtcgaactgaaaaacggtaataatacataccctatttcagttgtctccatatcaaatgacctttcctgtattgtggttggattcattaatgggaaaatcatccttattagaggtgacatttcaagagatagaggatctcaacaaaggattatatatgaagatccaagtaaagagccaataacagctttattcctcaataacgacgcaacggcttgttttgcggctacaacttcaagaatccttttatttaatacgactggtagaaatagagggcgcccaagtttggttttaaattcaaaaaatggcctggatctaaattgtggatcttttaatccggcaacaaacgaatttatatgttgcttaagcaactttatcgaatttttcagctctagtggaaaaaagcatcaattcgcatttgatctatcgctgagaaagaggatattttgtgtagataaagatcacattttgattgtgactgaggaaacaggtgtaccaactacatccataagtgttaatgaactgtcgcccacaataattaaccgaatattcatcattgatgctaaaaataaaatcatttctttgaattttgttgtttctagtgcaattattgatattttttcaacctctcagagcggtaaaaacatcacttatctgctaacttctgaaggagtaatgcataggataactccaaaatctttagaaaatcaaattaacatcatcatccaaaaggaactgtacccttttgctttacaattagcgaaacagcattcattatcaccgctagatgttcaggaaattcataaaaaatatggtgattatctctttaaaaagggactcaggaaggaagcaacagaccagtacatacaatgtctggacgttgtggaaactagtgaaatcatttcaaaatttggtgtcaaggaggttcctgacccagagagtatgaggaacttggctgactatctgtggtctttgatcaagaattctatttctcaacgcgatcatgttacccttttgttaattgttttaatcaaattgaaggatgttgaaggaattgatacttttatccagcatttcgatagaaaaggcatttggaatgaaggtgttgtgatggacgatatggatgatgtgacgtttttttattcagataacgatttttttgatttagatttaatcttagagcttatgaaagagtcagattttaagcgtctctcatacagacttgcaaagaagtattcaaaggattcattaattattgtggatattttattgaatctattgcataaccctgtaaaagccataaaatacataaaaagtttaccaattgatgaaaccctaagatgccttgtgacgtactcgaaaaaattactggaggagtcaccgaatgaaactaatgctttactgatagaagtatttacagggaagttcaaaccatccacttttgaagtggatctggaccggagagatacgacgggcgatttttctgaaaatattagaacagttttttacagttacaaaacattcttcaactacatgaactcaaatggtacatcagacgcaatgagcgagtcttcagaggcatcccacgaacatgaagagcctacttatcatccgccgaagccatccattgttttcagttcattcgttacaaaaccttttgaatttgttgttttcttagaagcctgtttggcatgttaccagcagtatgagggttttgacgaagataggcaagtaattttgactactttatatgacttatatttgaatttggcgcaaaatgatgtacccgagcgtatagacgactggcgttcaagagcaactggcgtattgcgtgagagcaataaattggtgtattctgccgcaagtaataatactagcaaaagggtggataactcaataatgctgttaatttcccatatggatcaaagtagtgcttcagcaaaagataagacgaaaattgacatagcttcatttgccaatgataaccccgagatggatttgctgagtacatttagggctatgacgttaaatgaagaaccaagtacttgtctcaaattcctagaaaaatatggcacagaggaacccaagctcttacaagtagcattgagttactttgtttctaataaactaatcttcaaggagatgggcggtaatgaagtactgaaagaaaaagtattgaggccaattatagagggggaaagaatgccactgttggatataattaaagcgctatcccgtacaaatgtagcccactttgggctgatacaagacatcattattgatcatgtcaaaaccgaagatacagaaatcaaaaggaacgaaaaactaattgaatcttacgataaagagttaaaggagaaaaacaagaagttgaagaacaccattaattcagatcaacctctccacgtacccctgaagaatcaaacgtgtttcatgtgtagactgacattggatattcctgtagttttttttaaatgtggtcacatttaccaccaacattgtctaaatgaggaagaagatactctagaaagcgagagaaagctctttaaatgtcccaaatgcttggtggacttagaaacctccaacaaactttttgaagctcaacacgaagtagttgaaaagaatgatcttttgaattttgcattaaacagtgaagaaggtagtagagaccgtttcaaagtcataacagagtttttaggtagaggtgccatcagttattctgacatcactatttaatgatggatcataacgatctattgtcgccgccgcgtcacaaatgcgccccgaacttgtcgcgaagttaatctgaaacatatatgttacctactgaaacagcgcatgttggaaaagacaaaggtgaagacgaagttgtatatttaagatagaccctttatacatccttttgaaaaaattattaatgtggcaaccgtcttttatttgacaaagtatcttttttctttgtgaaaccaattttaggttttcttgttatagtaagttcttaagaaaaagacaagaaaaccccttgcgatgtttaagacttcatataacttgtacgatttgaactatccgaaaaatgattcattaacgccaataagagactacaaaaatgactattttcataaaaatgatgacaaattaccagaaattgttagaaaacctacgagaaagttatcgaaacatgaaaacaaactcaacgataaaaaattcacgaataaacgaccagcaagtctggacttgcattctatagtggagagcctgagcaataaaaaaatttactctcctattaacacagagatatttcaaaatgtcgtgagactgaatttgagccctcagattcccaattctcctcacgagggatgcaaattttataaaatcgtacaggagttttacctctctgaagtggaatattacaataatttgttaaccgcaaataacgtatacagaaaggcattgaatagtgatccaagattcaagaataaacttgtcaagcttgattcaagtgacgagctattgctttttgggaacattgacactattgcgtcaatcagcaaaatactggtaacggcaataaaagacctacttttagccaagcaacgtgggaaaatgttggatgcgaatgaatggcaaaagatattcaccaaaaatgaggtacaacagcagctatattcaacttttgatatttcagaggcgttcgagcaacatttgttaagaatcaaatccacctacacaagctattttgttagccaccaaaaacaaatggaactatttactacattaaggatgaataagaatcatttttttaacaagtggtatgaatattgtttaaaagagagtggatgtataaagttagaggacatattgaaaagcccgatgaaaagactgactcagtggattgatactttggaaactttggaaagctgttacgaagatattctttcgccagaattgggcttgaaactaagcccgacaagaagaaaatattctttattttccaataagttagaaaccgaggtctccgagtataagagtaattccatgtataatttcagtttaaccccatcagagattatacaaagttatgatgaagatcagtttacacaccttttaaaacccccagacaaacaaaataaaaatatatgtaatgcatctcgacaagagagtaatttggataatagtagagttccttctcttctttctggatcatcgagttactactcagatgtatcagggctagaaattgtcactaatacttcaactgcctcagctgagatgataaatctaaaaatggatgaagaaacagaattttttacattggcagatcacatcagtaaattcaagaaagtaatgaaaggtttgttagaattaaaaaagaatttattgaaaaacgatctgtcaggcattattgatatcagtttaagaagaataaatgcatggaaaaaggtgatcgagtgcgaacgcccttctggtgcattttttgcgcacgataacttaatatcgaccatgtgttcttcgtacatagataaactgcatgaacaaaaaaatcaagtaacaattttgaaactcacagagctcgaaacagatgtgatgaacccacttgaaagaatcatagcccattgtactaccgttaaaagcaaactaaaagatttgcaagctttgaagaaagattacatgttatttttacaagaaaaaaaagcaaatgtgcgagatattaaacgtgacttgttgggaatgcatttccaaaacctgcaaaaccagatgaaaagggaattaccggtctttattactttgatccacgatactatcgaatgtatcttgttgaactatatcaaagtcttcttaaaatatttggaaatcattgctggtggaaaaaaatacctgcaaaaagatcttgaaaatatgtctcttaatgactctatagctaccggccaaattaaaaatcttgatattttgcagtgttattctaaatcacgatatatgacaaaacgcatggtaagaaaagattggcctttccctggagaccctagtggaagccgtgttgtcagaaaacttttcgaactttaacaaaagagtatatttagcttatagtttttagaatgttttgttttcttttttattaaagtagtactactgcgctggagcagtatatatgttgaactatagtcagtcacctataatttgtttgctggcgcgaaggagaaagaaaattttaattaattcatgaaaagccttaagaaaaagtttaagaggaaatgagcaaatagaaggcaaatagagggtgaaagcattatggccgacatcaataaatatattccgatggttgacgctattttgagcgtatccaaccccgatgaaataagcccaaaaagggtgaggaaagccctgcaaattctctattcagttaatttggattcacaaagaaagttaattaatgaattgattcttgagaggttcggcgatatacaagaaaacccaagagtcttaattccgaagaacgacctcattagtcgggatcaagaactatctttgaggttacagaaggaagaagaaagacccttgaggtctacgaggaaaaggaaaggtaaaagtgaaagtaaatctaaaaggaagaagaaaaagaatgatagtcctgattccaacagcatttccgtccgcaaagttctgttgtcagctcctttacaaaagtttctaggatctgaagaactgccacgaacgcaagtagtgaagatgatatggcagtatatcaaagagcatgatcttcaaaacccaaaagatcgtagagaaattctatgcgatgagaagatggaaccaatttttggcaaaaaaatgacgatgttttcaatgaataaactcttaactaagcacttgtttaatcccgatgaaattgtgaaacatgaagaggaacaaaagcaaacacccgaaaaagaaatcaaattggaaaacgaatctcttcccaatttaagcggttgatcttggctgtagcacttatacaaatttaatgattttttttcctctttgatgacatgtataaagcacactgcacctactgtattgtacttgaaacaggtaaattaacaattaatgtagcattagtaataaataatttcacttcacggcgttaaagaaatactatggcaaattcgatttgagaatttcgtcaaattctgatgatatcaattaatggcatattttttttattttttatctggagaaaaaaatgtaaaaatgacagcagcatcaacaatgaataaaagcaagtacaatagtcgtaaagatctatattaatttcatggcagcacaataatacacgttgtttaaattagttaaagtgtcactccttgcttatcgaaggaactatcgattcctaattatggcaaggcaagggaacttctacgcggttagaaagggcagggaaactgggatctataatacatggaatgaatgtaaaaaccaagttgatggttatggtggtgcaatttataaaaaatttaacagctacgagcaagcgaaatctttcctaggtcaaccaaatactacatcaaactatggaagttcaacgcatgctggagggcaagttagtaaacctcataccactcaaaagcgagttcatcgaaggaatcggccacttcattattcctccttgacatcgtcatcagcatgttcatctttaagctctgctaatacaaataccttttattcagtaaagagtaatgttccaaatatcgagagtaaaatctttaacaattggaaagactgtcaagcctatgtcaagcataaaaggggtataaccttcaagaagtttgaagaccaattagctgcggaaaacttcattagtggtatgagtgcgcatgattacaagctcatgaatatatccaaagaaagttttgaatctaagtataagctttctagcaataccatgtacaacaagtctatgaacgtttactgtgatggttcaagttttggaaacggcacgtcatcttcaagggcaggttatggtgcatattttgaaggagcgccagaggaaaatatttcagaacccttattatcgggagctcaaactaataatagagctgaaatcgaagcagtatcagaagctttgaagaaaatctgggaaaagttaactaatgaaaaggaaaaagtaaattatcaaatcaaaactgattcagagtacgtaaccaaattattaaatgacaggtatatgacgtatgataataaaaaacttgaagggctacctaattctgatttaattgttcctttggtgcagaggttcgttaaagttaaaaagtactatgagttgaataaagagtgcttcaaaaataatggtaaatttcagattgaatgggtaaaaggacacgatggtgatccaggaaatgaaatggcagattttctggcgaagaaaggagcatctagacgataatgctgttttttgcttggcttcttactggacctgttgtacctgtaatagaaatatatattttatatcttttgcatacatatacatacatcagctatttggttttttaacttacccgataactatctataagcgtgtcaccatgatatttgcctgaacctcgtccacagttgattgtgtttatttttacttttattcatagctatttgatttcagtttcagctaaacgttcagcaagatcatctacttgtacttctagcagttccttttcaagcctttccgtttcaatttcttcgagtttttcatcctcgtcctcgtcttcctcgtcctcgccttcctcatcttcactatcgacctcttcaaaatcgtcaacctctaaatcatcaaatttgctttggagcaaatctaaagcatcagaatcttcatctaatctgttaccatttatttctagcttttccaattcaggtaaatttcccttttccatagccggtaagaaggatacttcaatggtttcttgagccatttcattatattcgaatttcaagacatgcaaattggggaatttaacttcggtgaatactttaaagacttcatctgaaccagcagttttcaaaagacagtcgttcaaattcaattcaaataaactatccttccatgtaggcaaggccttagcaaggatcaaagaagcatgtttcgtgaaagtattgtcttgaagatccaagatttccaagtttttcaagtactgtaaaccgtaatgaattagcgtggcgacacctttaggcctaataccattttggtacagctttacgactttcaaaccttcggagtggcttttcaaacccagagctaagtagactgcggatccattctctaatctatttctaccacagataaaagtttccaaaaatggtttggaagcagctttcttattttgagcgagatgaaatagggccttaccaatcctttcaccagcaaaagggcccataccattgttacttaagatcaaatgtttgatattcacggcatgtgcaatgtaatcttctagtaactcgattgttcttagcccaaacgcattatcagaaaggttcacaatctccaagtgaggacatttcaacagaacaggcaataaaaacttcaacgaatcaacgacttcgtcaaccaacctcgaagtgtataagtcagcaaaatttacttcaaccaaagattccctgacctgtgtattttcagcgatgcatttagctaatgcttccgaagcttcagtaccgattgtattccctgaaaggtctaatttggtacaggttttcaaagctgccaattcttccaggtatggtttgatatcgtcactggttgttaacttgagtgccttcccagagatggagtaaacttgttcttcctcgtgctgaggaacgaagtgcaaggtagccatagctaaaaatctgtttcgaaagacagcctgttaaaatggcctatattcaccttttaccgtgatattatgcctttgatcaatatcttcctaataaatttttttccattaattgtcccacaacgtgcatagtgacatgcattccatgaccaaactaagagctttaaatcaaaagtagaatttgacattatgaaacaacacgacaacaagaaaagactagaggacttcacagaccattatgaacggcggaggcaagaatgttttgaataaaaactcagtgggctcagtatcagaagttggtccggactcaacacaagaggaaacgccacgagatgtccgtcttttgcatctgctcctcgcatcacagtcgattcatcaatatgaggaccaagtaccgctacaattgatggattttgcacataggtacacacaaggagtccttaaggacgcgttggtttacaacgactacgctggcagtggaaattctgccggcagtggattaggagtagaagacatacggcttgccattgcagcgagaacacaataccaatttaagcctacggcacctaaggagctcatgttacagttagctgcggaaagaaacaagaaggcattacctcaagtgatgggtacgtggggtgtcaggcttcccccagaaaaatattgtctcacagcgaaggagtgggaccttgaggacccaaagtctatgtgaatgcaccgcttatatatcataagtacactaaatcaagttcttccggaagatgcgtcatgtagaatgcataatagagtaatatacactaaataatgcgctagtcgtgtatcgtgatcatgttctctaatgttctttttcctgcctgccctttcctacatggaaagttagagaaatgagatctacacgataatgtagtaacaaatggacccttaaacatctcaattcatcttcttgagagcactttccgcgctgtattgatttttagaacgtgaaaaggataaactgaaaacttgaagtcctaaccatgttgtctcaaacctccataccggaagtgaaagaagacgtgataggctatgcgctacaccagaggagagccagagtgggacaattccaagacttgggtccgcctgatttaattactttgatcaaatcgttaccttcatcctcgagcacaacaactgctactgcctccgccaacgataacggagcaacttcaaacatcaatggacaagatcctacgaccatagttacggagttacattcccatgacaaattaaaggggcagatcggcactttcttttactgtatgggtatcgatacttcggatccaacttctattacaatctttgccaaaaagataaccgatcttttcttagacacgccccaaatttggtttggtaagaagaagcactttcacgtatcgaagatttctatcagttcttggaatgcgtttaggaaatatgatgttaacattatagttcacattccaggaactgtgcaaacctacattataaatagcgacggtgaacaatcgcaacttccctccgtggcagaagcgtcatctggccgcaactcacaggatttaaacgtcaacatgatttgggcggaaacgtttatgagtggtattgtacgtgacattatgattatgaaagataatcgtgcggatggagaatcccagaatttggtagaaacactaattttcaatccatttacctcgggtgagttggaagatgttgccaataactttattaaactgttccccttggtctatgaaaaaggtgtttatttagatgcacctactcacgttttaaatccctcgttaaccaataattatttagtggaaactttagtggaaatagttaggttaactaagagtttggaagcatgtcgtaaaatgctcaagaagttaatagaaattcatccagaagcagtaataatattaattcgtgtttattttgcgtgcgatttagagatagatgcagttgacctgatcaacgagcaactaaattccccctcttcgttcttagccgacgattcaaagactagccatatccagctaatcttcaaatccgaattattaagtattcaaagtgaattcttactggatgtcaagagagattacaagcttgctaaggaagtagccatggaggctgttaactgtgcaccaaacgaatttaaaacttggtatttattgactagaatatacattaaactaaacgatatgtcaaatgccttgctatcgttaaacgcctgccccatgtcacaggttaaggaaaaatacgttcttagaagaattgcgcctattacttcagatgaaaatcttcatctgccattaccattggatgcctcaattgaggagatttcgtcattgaaccccatggatgtccagttggagcaaaagtccgcagatccaaacctagtcaatctctctgcgtcaagtttaaagtctactttccaactagcctataaattattgacagaaattgtccaaataacaggatgggagcagctgttgaaatatagatcaaaaattttcgttatggaagacgagtaccaaggctccacttcttccattgatgaagcagaagttcgcggtaatgatatatccaaaatgagatcaaagaggctatgcgaaagatggttggataatctcttcatgttactatacgaagatttgaaaacttacaccgattggcaatcagagcaattgtattttgatgctcaaaacagtaaatatcacaaattaactgttgaatgggaattattcggcctttgtgcgaaaagactgggacatcttccagaagctgcgaaggctttccaaattgggctttcccaaagattttctccagtatgcgcaaagaatctattacagttttacattgacgagcataagcgtattaggagggattcagtctcagcaaactccgagttaacctcttctcaaatattgtcaagtatcaatgacatcgacagctcaatcatcgatctagtagtcaagatttgttgctggaatcatcgttggtacatcgagttctcaataatattaatagatgctctgagtgttgcagtacaagatatgggcattactaaagtacataatgaaattgcctctagattttctgacccagtagcccaattgattgacgataacattctaaattttctgaagaatttcacgaatgacactttcgataattagaaaaagatgaatacaatcaataaaaaggtgaaagaaatcaattaacaagaaacgggttatgtattttatgtatgatatcctggcattgtcatgtataggtcaccttcttggggaatttcccattttcaagttattctgcctctaatgcgataaccgtaatcttaaattgtttaatttctttttcacaatctgagccacgcccgaaaaaaaaacaatgtaatccgcgtaaagcgaaactgggtataacccaaaaatagaatgtaaattaatgaaaagcccatttctccaaaagatcagctttacacaaatatctaatcaagtaattgactgtgtacattgtcctttatctcattttgaatcacctttattaatttttggttgatatataggacgaacaaattagaacgaaatcatatccagaacgcagatatgatcgtcaatattagtgcgaagatgatcttatcgatatgctttacgtttctgtcattttttaaagccactcgtgccatggatttggatactaccagcaaaacgtcaatttgtgatgcgacagcgttaattcaaggtggtatgctggattactatgagggtactagatacggtggtgccgttgggatgtttcagtcaccatattattggtggcatgcaggggaagcatttggtggcatgttggaaaattggtttctttgtgagaatgatacatatcaagaattactatacgatgcactattagcgcaaactggttccaattacgattatatcccgtccaaccaaacgatggttgaggggaatgatgaccaaggtatttggggtattactgttatgggtgctgtcgagagaaattttacagaccccggtgacggcaagccaggttggttggcaatggtacaagctgttttcaacaccatgtactcaagatgggattcagagcactgtggcggtggtctgagatggcaaattttcacttggaatagtggttataattataaaaatacagtttcaaatgcatgtttgttccagattgcggcgaggttgggcagatatactggtaacactacatatttggaggttgctgaacaggttttcgactggctagtggatgtcgggtatgtggttcttaacgatactgcaaatgtctttgatggtgctgaaattgatacaaattgcactgatattacaaaaattgaatggacttataatcacggtatcgtgcttggtggtcttgcatacatgtataatgctacaaatggaacaggtgaatgggagaccagtttgacaaaaattctaaatggtgctaaatcttatttcttcaaagatagtattatgtacgaaagcgcttgtcaagactatggcacctgtaacaccgatcaaagaacattcaaaagtattttttctcgtatgcttggtcttacaagtgtcatggctccctttactagggacacaattgatgatttgataaaaacaagtgctgaggccgctgcaaaatcatgtaatggtggtacagatgggcatacatgtggtttaaattggcagaaacaaaccaatgatggctactatggattaggtgagcaaatgagtgctctagaagttattcaaaatcttttaattcatgacaggccagctccatataaggaagataatggcggtacgtcaaaaggtgacgcgaatgccggtatgaactcatcgaccactaacgtgctacaaaacaatttaaacattaagaaaggtgatcgcgctggtgccgctatcatcacagcagtcatactgagtgtgctaactggtggggctgtgtggatgctgttttaaatgtgtcaaactaggctcaaaaaaattttattgtattctaatatttaggctatccttttctttcagtaaaaatgtttatgtgctacatacaaaacccttcatgatcaaaaactgattaaaatttagagaggaacaattgtttttaaaaaaaatactaaaaaacactcacgatgggggtcgaacccataatcttctgattagaagtcagacgcgttgccattacgccacgcgagctagtcatatgtttctttcgtctttttcatctgatgacattctagtggaacatttatggtaagataccgattccattttaaggatttctataccctcgaggagaacttctagtacatacataattttatagctttgaccaacaatggaatcccaaaaattatcaaattttttatcaaatattcaaatatatcaaatattctaatgttttataaacgttttatgaatgacatatatgcgataattatatggctaaagaaaatcaatgcaagttccatcatggttgtgtaaaaggaacgtttcagcttgtatctgagaattttcttttcttattcttttgtgagggatcttttaacacagattcactcctaggaatggcagctctttgtttggcgtaaaaatctaacatttttttgtcacgaagagcattttctgcagccctaatacccgcaattttgatatttctgcccacaccggtccctaaaactgttccatcacctactctgcactcaactatggaattaggatcaactgcagtgggtttttttacggtaacataatgtagacgtaatgaagcatagccaatcaaagagtaaagctgccttttagcattcatatcaagtttatccgtcttctccaaggcaacttgattacgggtagcctcctcaatgacaggtttggcaagctttcttaaccattttcttattttgggcaaattattccttggatcatcttccatcaagccgccaatgtaagcttcgaacacatctgcatacagttttagtttgccgttttgaaaattggaattttcatccttcaagtcaaaatttgtcttaagtttctcatggaaattgtacattattgaccattgtttgatctgttcgttgcttaccaaattcatccttaatgttgataactgaccctcgctgtaatcgggaaacttgttataaataattaatgtcataacagaatttaagatcgaatcgcctaggaattctagtctttcattatgtgcgttgatcatttctgatccagacaagtaaactttatcctttattgtggatttgtgaataaataccctggccctaatcgctaaatcttgaatctctggtaattttggaggccattttgttgccttgacgatatcaccagcctttgttgggtcatagctatcttctccttcgtcttcttcttcatcttccttttcatttaaattttcgtacacatttacatctattttctctcgcttttcccttttaacttgttctagcttctctaacttttccatatcagctttactgatttcttgcaatataggttgcttttgttcagtatcaaattcattttcataatcagtaatttctgtcaaaattgcgtcttttttaagatcatgtaaggtttttaattcagctgccagttttaattgataacgtgatagagaaggaagtatctgaacaggcactctatcttgattgttaacggcttcattgtaagctaccaaatttggtgaaagttcaattattttattgtaagactccaccaattttgtcacagcatgttctagttgaatcacctcaagatatttgtaatttgatatcttaaggttgcctttcaaaagcgtcttggtattgatattttcgcgctgctgtgaaccattttcgttatctagtttattatcattctgggttttctttttacctgctacttttgagcccattgttttgaaaagcttgtaaataggacagttttgctctcttctatatgcgcatttacttgcctcactttgatcgagcaggattctcctgagagtgactatatgacctgataatgagataaattttgcgatgagctcatgaaaaatttcagcatggtttagggccgcatttaaaaaagaaaaaaactcgtacgtgagaaatagtaccacatgtaaaattttgtaaaactgaagtacctatgcgatatttagtagttatttcaatacagtatatagttgcttctccgattcctcttcgtttctctcaagtttttcttctgcgcttgtcacttcggatatgtcttcctggaagtgatctaacttatgctctacttcatcatcgattttgtcatcttggcgcccattttccgcattcgcctgtgtatcctcttttgaattttcaaattcaggggtttcaaatgagatcaatgcgccaaaatagtttctaccctgtttcttggaccttgaatggtgattagggattatttttccgtaaacgtcgccttttaaattcgttatatcccaattcaagccggcaattttcagatcaggatatcccgtaggtaatccaatgtctttcatcttcatacaccatggtggtagttgaccttcgggtaaattcattatggcacgaagctcttggctaattctccccggtctcttatgatcaaccattcttttccagttcgtttcctcgaaaagattcctattttcataatagacgtcaccgaagcataacaaatggtcaggtttccagttggctcctatcttgaaaaacacatcgtgtaacttcttgtaatccaaatccaaggcgcccattttcggctgcactcttgctcttgaggcctcctttagtgacttttcatcttgaccatccagtccgctttgcggaagcgtcgatctcatttgttctatatttgtcttcttgataatgtcaggaagttcaaaaggtcttttacctaacagagaacggccagatagatattccttcttggactgccagtggcttggaacaggaatgacatttttggtgcacttaattgacgctagtaagcctggatatcttgcgtcacaatcgtaccattctataatttgaggatacggtacctggctttttaactgcgaaagtgaaggtttttcagtcttcctacgttttcttgccgatagatgctcctcaataccatccgagggtgtatcctccaattcatcttctgctgtatgctttctgttcataactgggtttttctcaacaataacgacatgattgttcttttcatctttcgtgatttccttcggcgtatcattctcttgcacttgaaatcgttgtaaaacgtctttgaactctttttctaacttcgcatccactaccttattcgtctttcctttgctgttagtcaccccaccctttttcttttgctcaagccttcttgcatcaatcatggcggcgatctcagccttattatttaccacagacgcattcttattttggttatttccggaacgcttcctacttttggttctagccatttcaccactatctttatgatctgatgctctgcctatagatatatactctgtatgctactgccttcttaatacctttctaaacaataccaatatactgtattggatttctatatggttgaaagttattattcttgcaattatagccctgtaatgaagctgcgtgattggacctgtgccctcttcttccattacttaccctatcacttttctttctcaagacctaggtcctgtcggcaaattccgctgcaataacgcgaagatcatgacttttttcactcagaaggcagagaatcacgattgataaagatcacgcaaaaaaaaaagatgattggctaaatgcatagggcgacaaacatgggcccttcttttgcactcatgttttagcttcctttgtcccattgtgtaaacttatgacaagatatcgcactctaaaaaaaaaaaagaaaaacgcattagcctcttgcatggatcttaccttctgtaacatttatatatctcgagaaatctacggacatttaaaaaacgctgtcaatacaatcttctagatattcggatttgaattttgcaaaaagtccgaagctgcccacctcaagtcattgtttcaactcgcttacggtatatatatctactttcattgagatataaacagcgctgatacaatctttttatataagtcttttgtacaaataaagctaggaaaagcccgacgtcattatagctatgccatctaccactaatactgctgcagcaaacgtaatagaaaaaaagccagtctcgttttctaatatcctattgggtgcctgtttaaacttgtcagaggtgactacattagggcaacctttggaggttgttaagaccacaatggctgcaaacagaaacttcacatttttagaatctgttaagcatgtctggtcaagaggtggtatcttgggttactaccaaggtttgattccatgggcatggatcgaagcctccactaaaggtgctgtgttgctgttcgtgtcagctgaggctgagtatcgtttcaaaagtttggggttgaacaactttgcctcaggtatattaggtggtgtcacgggtggtgtcactcaagcctacttaaccatggggttctgtacctgtatgaaaacggtggaaattacaagacataaatctgcctccgcaggtggtgtcccacaatcttcttggagtgtgttcaagaatatttataaaaaggaaggtattagaggtattaataagggtgttaatgctgttgctattagacaaatgaccaactggggttctcgttttggtttgtccagactagtggaagatggtatcagaaagatcaccgggaaaaccaataaagacgacaagttgaatccgttcgagaaaattggtgccagtgctttaggtggtggtttaagtgcttggaatcaaccaatcgaagtcattagagttgaaatgcaatctaagaaggaagatccaaacagaccaaaaaatttgactgttggtaagacatttaaatacatctatcaatcaaatggtctaaagggtctttaccgtggtgtcaccccaagaattggtttaggtatctggcaaactgtcttcatggttggttttggtgatatggcgaaggaatttgtcgccagaatgactggtgaaaccccagttgccaaacattagcgtgtattgtactataagttttttttaaaaaaattaattatttagcttagtcattttttttttttctgaggatattgctcttatgctggggtgcttcctatttgtctcaacttgttctaattgtactaaggttatcagctatttacttcatgcaaaccttaatatctatagattctttgaaaggaagccttacccatttacctctggccgttcatgaaatgttgaaattattaaattctacagaattgataatacataaaaataaactattaaagtatcagaaaaatattttatatcttaaaattcaaatatgcacagttcagtagaaagtggaaggtctcttgtaggagaaagtcttggtggatttttggactctgtgaggcaatgggaatttcaagtccttggtcaaaaattgcttaacgtattgtctcttgacgtcagcagtcttttcaatttcagcaaccttcaagatgtgaatagatctaaatctagctctgtgtctagcagccatgtcttggtataaggtttcgacggcagcaactctggagacgtctctgatttccttgtacatattgtgagtaccagatctggagtcgtatctaacccagacaccgaagttcttgaccttggttggatgagcttcgttgatttggttgatggaaacaatttcaccagaagccttcttaaccttgtgcaacttttgcaagaaataccagtaacgagacttggcaataacttcatttgaagcaaagattctcattctgaacaactttggttctggaacagattcagttggcaaacgacggccaataacttggtattctttaaagtgagccactgataaaataacaaggattttcatgaaaaatcacaaatttgaatgttagtatgaagtccatgtgacacatgagaaaagggaagcttttatggaggagttattatcacattcgcaaggtcaggtaatagccttttagacatttgaaagatccatgaaagtttaactcaggtgtttcgtcattgaaccaaaaagaacctatacacttcttttgcaatcgtatttctaggatggatgggatcatattattcagcatggtacaattaacgtcgttcatttcttttcggtcgtaacaaactcgctgttttccttgacatatttagagtgtaatcctagttgaactattttagtggtgatagtagcttaagttttaaacgcagtgtggtcattcatttcatgatcgctccgagcctagttctgcgatgtagatggcattactcttccatttttgtggcatagtttagtaggtatttactcactttttccgcactgtttttccttaaaagacttgaggaactatatagatgcttatgattgtccaaattcttcaacctcaatgtttaaaatgaaatttggcgataccttgccacggtcagattttggtacaggagggaacaagcaggcgcccggcttagagttgggctaagagcatcaaatgtgcgctggattctgcctcaatgcacttagtaaattgcagcagggtttagaggggaacgcttattgagaagcggtattcctgggctggtaccacaccgaagtgagcttaatttgtttcctgctctgcgcgcgctgaaaaaagttaactatttgagacataaaaacgctattctggatgtatgggggtattttatgtttgggttaaaagtctcaaaaaaaagatgaggaaggattgtggcacatattgcatacaaatttttaatggagatttatagctaaaagatagcgtattcatacattgaataacgcagttcttgagttaggaagaactgccttcttcctatacgtctaagaattaattatgtaaatagtatatagtttatgttctctgtagaaccatgggataaattcaccgacggcttcagccctttatatctttattacaggcaattggaagtattgcagtttacagcgtcatctacaatacaattagatgatgctgtagtagcaccataggcagtaggtgaacgcttttttctaccatgctcagtgtttccatggctgtcaaaggcttcttgagacgaagatggtgaaccacctgctatgatagaaaatcttctgcgaatatcctcattaacatctccagaaacaaattctggttgaacagttgcagaatgaataccgtgttgatggaatatttttcttatcagcttggcggagctcatgaatttatcaggtgcacagtctatttgaacgtggatagatgcaatatatattgattcagttaagttccagacgtggaagtcatggaccgctatcacgccaggtactgccaaaatctctctttgaatctgatcagcagaaattgtagaaggagtagcctgtagtaaaattcttgaagctctacgtgataagggcagagcggaagagaaaataataatggtgatgattaaagaaacgattggatccgagtaatatctccaagaatattcagttttccaaataaacaaagcagctgcaataacaccaatattacccagagcatcacctagtacatgtaagaagacaccatgcatattcaaagagcgatgacctggtttcttcgattcatggctgtggtcatgatcatcgtggttcaataagggttggctttcgtttgataatctgtttactactgattgtggcaacacttcaccaatttgccctgagggcccaggactcgaaatagcatcttcatcgatggccaaattatcgtttggaagagatgcatgagagtgggaatgagtcgcattagattctatgtccaaatcgttattcccgctttccacagagccatgagagtgtgagtgcagactatcgctgccatgatcgtggaacaaaaataaacctacgacattagaaattaaccctgctacaccaacgtataaaaccaaccttgggttttgaatttcttgaggttcaatcaatctttgtaaagcttcaatcataatagagaaacacagggcaataagaaaaacagcattgattaaagcacccaaaatttctgctcttttccatccataagtgtatttagcgtctggacccctgtttttggccacatccacagcccatagtgccactaaaagagagatgatatcattcaacatgtgaaatgaatcggcaatcaaggccaatgaatgtgacatataacctatggtaatttccaataggaaaaaaaccgtgtctaaggtcaaaagagagatgattctcaattctttaccggtgatcatgactctattagtttcctggtattcctgacggatatcgatagggaaaaattactgcgccaagccctttaaagtatcttgaatgttatattcttttatgaaactttgagctctgatgactttgcaatgaaaagttttagctgatgcagcaaccacctcattcctcaccttcaaggccatctgaagaaggaaaacagagggagggacgttatttttcgcaaacaaaaacggcattttttttcttttgaaaaatgaggttttccgagggtgtgtgggtctatgccaagaaatcatattagagtttttgtttctttaaggttgaccagcaaaaacaaaaaggagtcaccgtttatgacttccgttatatgacatatatattttcggcgtaggtagggaaagacaaatgcactcactacgctgcgtcatgaagagaaagtagcaagaattttttttgcttcctgggaagtaggctcagctagtaaaaagggttgtagaaaggaagtctggctgaacttagccagacgccttccccttagcagaatgaatactgtagtccggagatacatcaagagtccagaactcaacgcaaaagtttatctcatgggacctgcaccgatctgaaaaccgagataactttctttttatgtagtaaagatctcagtttttttttttttttttgaatctgtaaacctaccagtgccacggcggtagtttcttttttcaagtggaagtgctttagtagcagcgggtccgcaaagcattattgtttcttttttttgatttcttcttatttcttatttcttattctttttcttattctttttcttattctttttctttttctttttctttttctacatcatcttacttagctactcagtcgatttcatgggcgatgtatcgatgaatatgagaacgatatttaatttctttttagctagttctctttttttcacctataaaaatgcaactactttcatatcatttcctttccctcaaacaggtgagataaagataggactctcctactaaacatatatattactgaacgtcccaatcgaatatcgagagaaaatggtactttgcaaattactgacaccatattccttactgtcaattttgagtgtcggcgtgttcacggcgaccgccgcgccatcgcccagtattcaaatgacggaaaatacaaatcaagatcatcatgagcatgccaagcgtggaggaacgtgtgcgttccctaactacgatgggatggtcgcagtacaaaaaggtggatctaatggaggatgggctatgagccctgaccaagaatgttcctacggttcatggtgcccttacgcttgcaaaccaggtcaactaatggggcaatgggacccttcggctaccacatactcttatcctaaatgtcaaaatggaggtttgtactgtgattctaacggtaacttgcaaaagccaaacagtgataaagactattgttatgatgggaagggaaccgtaatagcgaaaaacaacgctaacagcggtgacgttgcattttgccagaccgtgcttccgggcaacgaagctatgctgatcccaaccttagtcggctctgggtcaaagcaaacgctggctgtgcctggtacagactactgggcctccaccgcgtcgcattactacgtaaatgctcccggtgtaagcgtagaggatgcatgccagtggggtagtagtgcaaatccacaggggaactgggccccatttgtagctggttccaacatggacgacaaccagaacacttttgtaaagattggatggaaccccgtctacctggaatcgtcatgtccgttcaagaacgttaagccttcattcggtattagaattacttgtgatgacgaatcacagtgtgaaggcctaccatgctccattgacccaagttctaatggagtcaacgaagtgacaagttctggcggtggttcttccggggctggtggtggaaacttttgtgttgtcaccgccagaaacggcgccaaggccaacatcgaagtttttgatgttggtagcggctcatcttctaaaggcaagagagaactgaatccgctagatgctattaccacaacggtcaccgagacgaagtacaagaccgtcactgttactgccaaaacttagtgcggttttttctaccttcccttttttcatctttttgttatatatatatacagagacactcatgcgaattttcgcaaaacgaagaaaaaaacataaaattttcgtttgtatctacatgattatcctttaattattacctttctgtcaaatgttttataggaatatatatgttaatacgagccaataactcactaaaaactcactgattttgctccctctgtttagcttcctgctcgattctcttgatggtctcctctctcttaaagtcgatgaccctcttctccttgaagtacttgatccagctatgggcgcaattctcctcaaatttttcattttccaccttgcagtgcgactttatactcttgctattcttggggtccattgcgtccaagatgtctgccttgtccaaacactggaagaatgcgtccctggactcccagcacaactttctctgtgaacgggtattagggggttgtgattcctttttgccaccatcaaatgaaaataagcccatcgctatattactaactgttcctttctgtatattcgtgtatctgtgttcctgcgcagcgctacaatagtacccgtctatgtatgtatgtatgtgtgtaggcgaatcttctcccccattctacaaagcagcacctaccaccgcagcaccgtttcacatgtccgtctcttttgttcagctcagctacaatcgtcaatcgcactttcttccgcgcgggcgagcccggttttgttggatttgctcaggtgccgatatataccatcaaggaacggacagggacctgacaatacaataggccatttacatcacaatgcacagggacagaaatttatacacgataacaataccaactaaacaaaaatatctcccgagccgatgcttattccgcgggttcgatgccgaaataattgttgcatacgctttatccaacacgatggagcgtgttgggcgcttaaaaagagactcactaactgttcggctttttggctgcgcgtctttgccgtttcccaacaaaaaacgatcatacttagtaacaagaaagacaaaagcgcaaaccgaaccgcccagctcaaccatcttcgccaagtagcggcaaacttatataagctccaacgatgtccccatcaattaagaaccctcgattgtcggcgatctatttttctattctgggtgtttctcggccttcgttcatctcgttctttctactcttagccctcatctttctcttctgcattcttttcacctcattaaaaacattcgcggcgccgctttaccccaacaaaaacagcccatcttttgttctacctctttcagataaggctcaacagatagacaataactgatcattcttttcttttgtttgcaacccctctgagttgacataaaagcgagaatacaaaagaaccagcattagtaacacatcatttttttctctgttcttcactatttcttgaaaaactaagaagtacgcatcaaaatgaccgaacaatattccgttgcagttggcgaagccgacaatgagcatgaaaccgctccaagaagaaatatcagggttaaagacaagcctttgattagacccataaactcctcagcatctacactgtacgaattcgccctggaatgttttaccaaaggtggtaagagagacggtatggcatggagagatattatagatatacatgagacgaaaaaaaccatagtcaagagggtggatggtaaggataagcccatcgaaaaaacatggttgtactacgaactgactccctacataaccatgacatacgaggagatgatctgcgtaatgcacgacattggacgtgggctgataaagattggtgttaaacctaacggtgagaacaagttccacatctttgcctctacatctcacaagtggatgaaaacttttcttggttgcatgtcacaaggtattcctgtggtcaccgcgtacgacactttgggtgagagcggtttgattcactccatggtggaaacggattccgtcgccattttcacggacaaccagctgttgtccaaattagcagttcctttgaaaaccgccaagaacgtaaaattcgtcattcacaacgaacccatcgatccaagtgacaaaagacaaaatggtaagctttacaaggctgccaaggatgctgttgacaaaatcaaggaagttagaccggacataaaaatctacagtttcgatgaaattattgagataggtaaaaaggccaaggacgaggttgaattgcatttccccaagcctgaagatccagcttgtatcatgtacacttctggttccactggtacaccaaagggtgtggtattgacacattacaacattgtagctggtattggtggtgtgggccataacgttatcggatggattggcccaacagaccgtattatcgcattcttgccattggctcatatttttgaattaatctttgaattcgaagcgttctactggaatggtatcctagggtacgccactgtcaagactttaaccccaacttctacacgtaattgccaaggtgacctgatggagtttaaacctaccgtaatggtaggtgttgccgcagtttgggaaacagtgagaaaaggtatcctggccaagatcaacgaattgcccggttggtctcaaacgcttttctggactgtctatgctttgaaagagagaaatataccatgcagcggcttgctgagtgggttgatcttcaagagaatcagagaagcaaccggtggaaacttaaggtttattctgaacggtgggtctgcaatcagcatagacgcccaaaaattcctctccaaccttctatgtcctatgctcattggatatgggctaactgagggtgtggctaatgcctgtgtcctggagcctgaacattttgattacggtattgctggtgaccttgtcggaactattacagctaaattggtggatgtcgaagatttgggctattttgccaagaataaccaaggtgaattgctgttaaagggtgcacccatctgttctgaatactataagaatcctgaagaaactgctgcggcctttaccgatgatggctggttccgtaccggtgatatcgctgaatggacccccaagggacaaattaagatcattgatagaaagaaaaatttggtcaagaccttaaacggtgagtacattgcattggaaaaattagaatccatttacagatcaaatccttacgtccaaaacatctgtgtctacgctgatgaaaacaaagttaagcctgtcggtattgtggtccctaacttaggacacttgtctaagctggctatcgaattaggtataatggtaccaggtgaagatgtcgaaagctatatccatgaaaagaagctacaggatgccgtttgcaaagatatgctgtcaactgccaaatctcaaggcttgaatggtattgaattattatgtggcattgttttctttgaagaagaatggactccagaaaacggtcttgttacatccgcccaaaaattaaagagaagagatattctagcggctgtcaagccagatgtggaaagagtttataaagaaaacacttaaaggaagacatagttttttactttcccccctgcccttcataaacactacgtttcattttctaagagcatcaatttgcaaacatctgaactacttgcacaatacatagtttcttcttctacagatacagttaataattaataaataacattacacataaacatgtttaagtttcatttcagcaagacaagattgacattattaagcgtgatctaaactatgaatttctcccgggtatgaaactacattctactattgattttaatagatgagcgattaaacgggatatttgaatttatgacttctgtaaaccatcgaatgccccaacttttagtaatcaaacatgcaccgaaaacaaccatatcaatcaatgtcttgcttcattcttgatttctcatctctttctttccttcgtaatttcaccttctccctccgctccttttatcgaagaaacatcatattacaatcaacaacgcattgcactatagtacaccaagtttgaaaataaaaacctcgcccacgttcatttatgcaacaagaaaaaaactcccataacagttagaaagcaatgaataaaacccaagcgtaataaatacattcagagaggatgacgataaaaaaagaaaagaaatcacgaggagagtaaaccaatataaaaagaacaaattcaaaattttcttataataaaccttaacatggagtttccgttaacacactatatggaagcgaaacgtgtgaatcaacagaatcaaccacagcatatcataaacctgaacatagacacgactgaaaaactcaaacgtgctataccgccaagcagaaaatccatttgctcctactttattttctacgtctccttgcaatctccgttccattttatcattctccttcaaactgaacacatccctccaccaggattaattcatagctttcgtcatgctacctgaatcttttatccggtcacttaaaaatgaacgcgttcatagcaaggcacatatatccaaagttaaaatgaacaaagcgcatcgcatagttgtatatgcaatacaatcaaatttcctcaaataaaaagaacaattgagagaatgaaaaaggaagagaagagtgataatttgagaaaaaaatagctaaacaaaacgataaatgattttgattgaaatatttcggtgcagtccttttccgaaaattggggacattcaatagaatttcatcaatggttatccctcttttagtagctaaaaactgaaaacaaggcctgaactaaaaaccattcttctttcaagttcgatttttatcctgaaaaaaatcctgaagagaaaaaatttccagaaatatccgggtgatgggctggattggcaaggtatagggctggattgtataatttgtaagagagcacagtaataaaaggaactttgtttaaaaaatgtagtacatttatatgaaatttatatgcgatagtctaccttctaaatggaatttcactacggcataatggacatgtattgttacccgatgatcgaaaccacttgtaaagacatgctccgtggaacttatttttacaagtcggacatgtcttcgaaggtagtttcctatccacggcatgtagtatagagtaacatatggcacattcctcgaaaccagaaaactgtaagtgcacatttttagtaaacaactccaacgaatccaaaacggatccattcatgcctgtaattacatgttgtgtagacattatccattgtttccatttttgttcacttatgccaactctagagacgccattcacttggatatttgttaaagggtagttttttggtagtttgaaggaaatctccaacttttggtcgtcaatcaaatagcttgccttcacttcattagtaatattatttaatttaatagtcaaagcatcatcattagaagtcaggcggtccatcttagaattgatatcgtcaaattcatttttgatcaaaattggcgagatgaactctgagacaaacttttcaatatcattttgtaatgtcctatcttttatatttaaccaccaaatactcgttaaacaaccgacgttgttaaacaactgataaagtgtatggcccaaaagttttttacattcttcaaatatgtcttctttataaggagagaaattattgccgacaatgttgtattccgaaatttccttggtgtcgacctgtttccaaaactcagtatctcttaaatctatttgatctgttatgaaatcaaacattctattgattaaaccagcttcctttaattgttcaataaatatttgtctcatattataagacgtatctttgaagtacatcagtatcaagtgccaataccatagatatttaataaatgaatttttattctcgtattcaaggtattcttttggcacctcatcagtaactttttgtaataatttttgaggtagtttaaattttgagtttacatcattatcagatgcactaccatctacgtctgagccagtttgtttttgaattctcagttcgtactcaattataatatcctgctgtgtttttaccaccaaagaacccaacaaagtagttaataatcttgattgattaatattactaccgatatccttatcattcaatacaacctcgaatattcttttgtattgagattctaactttttgagttccattgaggaaatgaccttgtacaatttctggtagaagagtgtggatactaggttatttctttcttgattaaagttaagaaacatcagttcaatcaaattttcttgaatttcatcatcatattctgagatttcttcgccatttttggaaacgccttgcgacaatgtttcatataagttcaaacaggaagagcgaagttctaacaaatataaagtgtcatcaatttgacacatcgatagagagtctgccagcaacctttccgaaagttcaaaagctgttatgcccatatctctgactccttcaaacctcatcagtttggtgaaaaaatccagtagtaacaatctaacggtgctaaagctaggctcgtaggcaagatcactatccaaccattttagtattgaacggaatatcatgttcagtctctgcggtgctataggaacaaactgtttatctgcctgtgggatatccagcagattatttaagagagctaacgacttgaattcgtgagcgacaagttctacttctctaatcccaatcaattgagatgccagcaatgttcttaatttcgtcatctcatcttttgagttggacctgttaaacatcaatagtaatatagcacataggagataatctttatcagtagatttttgatccctcacagttttcgtgacaaaactttcaaccgatgctaatagcccatttaatgtggtggatgaaacagtatcaatgctgttcaataaaaccttatataatactcttgaataataaaaaaagtagacagagttactttcagcaatatcaaaagtaagcatagcatcaccaccattagcaggctgaataatgtttccaacaatatcagaaaagttcaaatttactttgccatgtttgaaaaaggtatgcccaaaatcatagtaaagatcatttggttcctctgaaaggcaattataatcagtgacgagctcagaaactacagttataaatgcaacaatacggttattaacgcgctctggaagagcatcaagtagggcatctaagaatagagcatacctgatgagcttttgcatattttttaaattgataggcttatcatctgtaatgagcaaatgcgtgttagtacttaagctgctcaccaaggatgacctataatcaattgccggcatatatctggcaaaaacttcgattgcgttagcgggaaaaaaaatctgagaagtatcgttgcagtcattaattagctccacagcgtgtgtgacatatttttcttttgccccggggctgaaataaacctgagcatgttgcaaaattacttgggccaatttattagcgatttcagaattccctttagccaactttaatgacaacttgaatagtttctcattagtgtcttctgaaacttcatacaatgcacaagaaagaaaatcggtattcagcaataacgttgaaaaaaaagtttcatctaatttagacaaaacagcacaaagttgttcaacttgaccattggcaactgcgcttcggtaaagtgtggtgatagtcctttgatttaaaaatttattattacctttaaatatttccccactgtcgtcaaacttataatttttcataaagtcttcaatgtacaattctaattctagggaatcagatttcattaattgttgataaatatcatcatccaactcattcattgtggctaaaatttctgtctttggtaaattaaaagaaagcgcaacgataaaaaagtcttccaacgaagtaatcgcgtcagtattcattttgaaaaatttggagtttgagtactgtgccatgataccagcaaagttttgatatgttgattcttggaccaacgttggaatttcgtttataaatttccctatcttcccattcaagaaaatcatatcggaatctaaaaagtaattgagagcatcatatacaccgtcgtatttgttgaaaacatttgagggatctgtttcgattaattgcacaaaaaaatcgaataaacgactaattgcggattcgttatcaggagaagtaaccaataaagcaaaaagattcttctcaaagcttacctttatttttcttatgtcttcgtctgaagtgaagtaatcttcaatctctctctcccatttatcgggtggaaagacgccactaagagtctggttcagttttgtgtactcagataaagatttcccgcaagacagagtgttaaaaatctcactttccaccatctttttcactctttcttctgatgaatcctcagtgaacttcaaaaaatttgtccaaaactcattaagaacctcagcgctgtttctcgcagaaaagcccttttcattcaatctttgcaccgatttttgccaaaatggaagccattcaagataataatcaagaaaactgtgtcttttagtcgagctgtacaatgcaaacacagctttgaaaaatcctggcgatggtgaagtacaggaaaccgataaaaatttgagtactttttctttagaagatttatcgtatgaccatattgtcccatcttcatagccatctaaggtagctaaaaggttcagtattgatgggagaacagggcatacttttagaatattctttgacgtaatatgagtcaacgatttcaatagttttttcaccgctaacttcattatatttttgtgggaaggcatgtaacctcttgtataaagaacatcaatcaatcgaagaactgtttcgtaggcatttgtattttgcccattttttaagttaagtagtttccagattgactcatcagaaagaatcaccttaagactggaagaattacgttctgagacgtctttgttatgaacaaaaagcttaatcagcagcaatacggcacttgctataactctgtggtatctaaactcagattcttctttactggagtaacgttcatcagaaatggtatcttcattctcgtttacaacaatctcctttactaaattcaatagttgttcttgaaaaacagcccataaggcattgatttttgctgggtctttgttgaaacactctgttaattcattaagagaaggtttggaaacactataatcgagttcgcatgtaccgagaagtatcaaaggtataaaatcctttaaaaacttcgatattttcttccgaaggcttttgacaagcattatagtaatttgatgtgattgcagtctgatgaccttgtaatcactaattatcagtttagcatatatctgcgaccaacaaagaagaaaaatgtcattgaaaaagtactcattctggttaaagtcgctgatcaaattggaaagatccattaaagctttttcttttgtagtttcatctcttttcagaagagatttgaaaatgagtttcaactcgttcgagtacaaggagtttaaaagacttggatccggcaaaccatcaaagtagtttaaggatattctaacaccattatggccgagccctaaatctgtgttatactgttgaaatgtgttgattccaccaaacgacattaagaaccaactattgcttgaactttttttgatggcttagcagatttgaactattaagaaggacttctccagtattgtatatattgaagaaaaccatctgaagttgcaacatttgaatttttcctatgacgtttttttttcctcgcttcatcaatatttttcagttttccatgttgaggccataatctgggttaactcgaattgacaagtatatagtcaagctggaggtatgaagtacgtaacatttaaagagcattgagacgatattctgttcatgataactataattttaaatatgaagttacgctaattgcaaagtagcaaaaaatttggacgagtccggaatcgaaccggagacctctcccatgctaagggagcgcgctaccgactacgccacacgcccatttcttattgtaatttctagtcactgtaaaaagtgaaatcagtttaaaatgaaagtgtctatcaaaacttattatccactatcaagtaattactcatgattgtcggaagaggaaccacctaccctctatagtctagcatccatcttattacatatacgatgtagaaatatgacataaaggtaaagattggaaagctgccatcaaatttaatgggggtggaacgcacgacttgataatgcaataggataatgagtgacaacatataaagtggaacgagaaaccataatattattatgaagaatcatcgatattgtccaaattgtattgttatggaaatggtattcaacaactatctcaaaagtcacctatttctcgtgcttttcgcattctatcacctgtattattatatttcatcaaaaagatgaatcatccaatgtaaatgacacacaaatgtgcaagtgccaagctattaagtggaataatggccttgttatttaatggtaagagccttctgaggccaatctgccttcacgtacacaaccaccttgttaggaacaataataccaacatagtttggccgtgagactaaccttagtgggttattgcaatactcaatactgttcttagacaattatccaaccatcgccattaaatgataaaaaaataaattgactgcttaattttgctgatacaatgcactatattatcggctgatgtaatggtattgttattcaaccttctctcggcattgcaacatactaatagccaccctagggtgtcattagcatgcctataccgaagcatacgaatgcaactagccatcaattccatcaccctgtcattcaactccgcttcacgatcaggacagtttgcacgttatcagataaactatgatacagctattattgaactctctatgatattctatgagcgtaactattaaaaagtttgagagaacagtaggttccacttgagctacatctgggttgatagtaaggtctgacattgttactgactgacattcgcataatttggtaccggtacaagctttggcacatgttcgtgataccttcgtctggttcattcattggcgccagttctcccatttcggacgattctttccaaacgaggtcttaggattcgacgacgtgctagctatagcacaaggccaagaattaacccaaaaactgtatattgtctctgcctcaatgctatccgaatatcaagcccgcaaatatggacagatatgtccagtctaccatatagtactctggattcttccggaatcaactgctgactttctatatatgtagccgcatctatgtgttcagatagtttttatcacgcaggttgccgtttataccttgttttcttggaagtatctcgagtaacagtgatgctcagtctcgtttagaagagtgtaccttctcgggatcctgcgctctgatgctggtaaattctagttggttcttgacacttttcaaataatcaaaccatctcatttgcgatagcaaatgtacaacgtgtgaaagtaaagaagttcataatatatgggctgttcaaattcttgttcactgcgtttataaataatctttctggcaagttagacaaattaagagcaagagttgcataagagcagcatataaatacacgtcaatttaggcatttttgtgattattaagttcatcaaagtgaattaaaaattcattattttactattttttttttttcacccttaacagcaaggttgaactctataaggaaaagggatagatcgtgcggcacaccagaaaaaggggatcagtaaagtgatgcaacataaatacatatataagagagcataattgaccgctgaactgcaacgcactctctgaaatctcaccttttggcgatgctaaaacgtttcaagatattacacgtcgctcttaacaatccaggctgaacaaaacaaggaataatgttacacaggcacggttctaagcagaagaacttcgagaatatcgctggaaaagttgtccacgaccttgcaggtctgcaattgctttctaacgacgttcaaaaatccgctttccaaagtggtcatcaaggatcgaacaatatgagagatacttcgtctcagggcatggctaataagtattcagttccaaaaaagggactacctgctgatttgtcttaccaactgattcataatgaattaacactcgatggtaatccacatttgaaccttgccagtttcgtgaacacttttaccactgatcaggcaagaaaattgattgatgaaaatttgaccaaaaatcttgctgacaatgatgaatatccgcaattaattgagctaactcagcgttgtatttctatgctagctcaattatggcacgccaatcccgatgaagaaccaataggctgtgccaccacaggctctagtgaggcaatcatgttgggtggactcgccatgaaaaaaagatgggaacacagaatgaagaatgctggtaaagatgcttccaagccgaacattataatgtcttctgcgtgccaagtggcattagagaaatttacgagatattttgaggtggaatgccgattggttcctgtatcccacagaagccatcatatgcttgacccagagtcgttatgggattatgtagatgagaacactattggctgttttgtaattttaggaaccacctacactggccatttggaaaatgtagagaaggttgcagatgtcttgtcccaaattgaggccaagcatcctgattggagcaatactgatattccaatccatgcggacggcgcttcaggtgggtttattatcccatttggctttgaaaaagagcacatgaaagcttatggcatggaacgttgggggttcaaccatccgcgtgtggttagtatgaacaccagtggtcataagtttggcttaaccactcccggcctgggttgggtgctatggagggatgaatccttactggctgatgaattgagattcaaactaaagtacctcggtggcgtggaagaaactttcggtttgaatttttcaagacctggatttcaagttgtccatcaatacttcaattttgtttctctaggccattcagggtatagaacacaattccaaaattctctatttgttgcaagagcattttctttcgaattattgaattcgtcaaaattgcccggatgctttgaaattgttagcagtatccatgaaagcattgagaacgattccgcccctaagtcagttaaagactattgggaatacccccaggcttacaaaccgggtgtaccgctggtagccttcaaattgtccaagaaattccacgaagaatatccagaagtgccacaagcaatcctttcctctttgttgagaggtagaggctggataataccaaattacccattaccaaaggcgacggatgggtccgatgagaaggaggtattgagagtggttttcagatcggagatgaagttggatttagcacagttgttgattgttgacatcgagagtatcttgacaaagttgattcatagttacgaaaaggtttgtcatcatatagaacttgcctctgagcaaactccagagcgcaagagttcgttcatctacgaaatgttactggcattggcatctccacaagatgacatcccaacgccggatgaaatcgaaaagaaaaataagctaaaggaaacaacaacgagaaactatagaggaacatgttgagttaaagaggtcatccaatgtaccgccctctatatgtatgtacctttaccttttatttaagtactagtgctgtttagttaggttnnnnnnnnnnnnnnnnnnnnnnnnnnnnnnnnnnnnnnnnnnnnnnngggtttttttttttttttttttttttttttttttttttactattactttctttttcaagcttttaagcgccggaatgatatttaagggaagatgactaaagggacagcgacgaggatccagcctggacagtgatagaaaagttatgcgggaatacgtatatatagtagtataaattgtggttatagaacatcgcagcgcctttaaatatattgtcttttatttcaatcttattccatttctctcttgcaaccacggcaaagctggagctatgtctgaaaaatcagctagcaataacaaagctgaattcaaaaggcagtcatcgccattcagagaaatcatctctgcggatcacccaatttataaacctgctaagggaaggtactggctgtatgtggcgctaccatgcccgtgggcacaaagaaccttgatcaccagggccctgaaagggctagcgcctataattgggtgcagtgtagcgcattggcacctggatgacaaaggctggcgattccttgaagaaggagatgggaaaaccaatgaaaggcactggtttgacattgcaggcggaattagctcagtaaatttaaataccagtactcctgtggttaacatacccaataatgcgcatcggttgttggtcgacggaacagatgaaccgcattacgggtacaagagactaagcgacttctatttcaaaacaaagccagactataagggaagattcaccgtacctgttctttgggacttggaaacatgcactatagtaaataatgaaagcagtgatatcatcagaattatgaattccgctgcgtttgatgagtttgtcggcgaagaataccgtcaagtccgtctggtacctcggtctctagaggcacagattacagagttcaactcttgggtgtacgataaaatcaacaacggtgtatacaaggccggttttgcagaatgtgcagaggtatacgagagggaggtaacaagcctttttcagtatcttgacaaattggaaaatcttctggacaagaagtacacagatttggaggcgaagtatggtaagaacaacaaggacaagatactagatcgctactttgccatcggagacactctgaccgaggcggacgtgagactctacccaacgatagtaaggttcgacgtggtataccatcaacacttcaaatgcaatctggccaccatcagagatgattattcccgtatacacacgtggctcaagaatatatactggcgccacgaagccttccagcgcacaacggactttacccacataaaactcggatatactcgctcgcagccacgggtcaacccgattgggatcaccccactggggcccaagcctgatatccgacctctctgaaatttttttttttttttcgattagcacgcacacacatcacatagactgcgtcataaaaatacactacggaaaaaccataaagagcaaagcgatacctacttggaaggaaaaggagcacgcttgtaagggggatgggggctaagaagtcattcactttcttttcccttcgcggtccggacccgggacccctcctctccccgcacgatttcttcctttcatatcttccttttattcctatcccgttgaagcaaccgcactatgactaaatggtgctggacatctccatggctgtgacttgtgtgtatctcacagtggcaacggcaccgtggctcggaaacggttccttcgtgacaattctagaacaggggctacagtctcgataatagaataataagcgcatttttgctagcgccgccgcggcgcccgtttcccaatagggaggcgcagtttatcggcggagctctacttcttcctatttgggtaagcccctttctgttttcggccagtggttgctgcaggctgcgccggagaacatagtgataagggatgtaactctcgatgagagaattagcaagcggaaaaaaactatggctagctgggagttgtttttcaatcatataaaagggagaaattgttgctcactatctgacagtttctgggacgtcttaacttatattgtagaggactatcaaatcatacaaatattgtcaaaaaaaaaagactaataataaaaaatgaagttatctcaagttgttgtttccgccgtcgccttcactggtttagtaagtgctgctaacagttctaacagcacaagctcaaagaatgctgcccaaccaattgccggtttaaacaacggtaaggttgcaggcgccgctggtgttgctctagctggtgctttggcctttttgatttaaatttagactttgtttggaatacattgaaagagaaagagagtggttaatcgggtgtagaaagaacaatccaaagtcacctttattggcgatatgtgtcattgttaatccattggccacatttttccgatgattttctctcggtgtgcaatatagtaataagttttcaccttttccggtgaataatgaaaaaaaaacgaatacaaaaaaaaaagtaatttctttcaagtttatatatataacaatataatattaagtaattttaatcgaaaattttttcctctaaagaacccaaaaataagcaactattgaatgaatatctaaaatgatcggaagaaacggtgtggcgcggcggagggaagcgaaaaattgggaaacggaagcaatcacttctgtattaacaattgtttaaagctggggtgactgaacctactacccgatttcatattatcattgttagttcctaattgctcgttcttaaacgatttccagatatcattataaaatatgccgaacacagatggcgagtcattgtgctcgtccatgccaatactcagccccttcagcgaaacattggtcttagaacttgggtattggtgcctgtagtttttgacaaaacgctgaataaactcttgcttctgggacatattcagttcgtgccattttttaaaggggaaacatgcctccttatcgaagctgtgcgaagaagaagaaacaggcgtgtatatcgtgcttaaaggtttgaacccaattcttgttctgatgtagcttacgaaaactttaccaaacattaacacttcacactcgaccttcttcgttttgctgcttatatggtacttgctgaacgacgcgatgatccttttgttttgttttctgaatgctcgtgtaccccactttccctattgttctcttgtttcgtgtccttgcttcctcggactgcgcatttcaacatgacacaaaaaaaaaagaaaagaaggaaaaaaatcatagtagaaactgaggaattttatactcgtcttatttagagtcggataggtcaaactctgtcaggggaatagagttctcttcgtcgtcaattattggggttaggtccttggcagttgtttcgttgtttgccgcccttatccttattacccacaacgtggcacttatgatgattatcataccaatccacgaccagatatttggccaatgcttgtacagtgcaacgtcccagaaaaccgcatatagtagttgtgtgtatgtcatcaaagaccctcttccagcacgttctctttggatacccatagttaatagcagctggaagatgaagccggacacacctagattaccaaacagtatccattgttttttggaatgtggtatctggaatttcattgaagggatagtgttaatcccaatgaaggacactatcgctgtgatcaaagaaaaataactcacactcattatagcgtgagccctcttaccaatataacgaataatgatgtagacgcaactcatccctaaaacaccccacaacccaaccaaagtggcaatcaatctcgattttgggtccgatgattctactatttgagaggaagagtcggtcaattcgggagttccaaataaaaatgaaggccttacaattaacaccacgcccagcaatgagatcagcgaaccgagcgcttccactttggtgaatctttccctcaggataacccacgacaggaatattgttagtgatggtgccaaaaaagtgatcaaaacggcatcactaatcgtcaagtacattaacgaataatacattccaaagacaccgaaaaatccagtgcaacctctcaatactaaccatttgcgtacttcaggtttaccaaatggtacatccgaaattgtgctcttattaatatacatgtatatcaatgtaccaatatatgttattaccattctaactaataagatttgtaatggcttgatctgtctatcattggcaatatcatcgggatcgttttctaagactttagtagacaccaccatggccgagttgaagaaatatgatactgtcaagagaacaagcccaatatttggtttcaaataatctttacttattctttgcagcgttgtttcgttgccatcgacgttaaagtcttcattgctgtttgactctttcggtgaaagtgatctcgtagtagacggtagttgcaaactcgtatcattcatttctttagaaactagtaggtgtgtattgttttctctttccataaccttcggtactgatggattcattttcttatctctatctattttcttcaccacagcaacaacaaattcatgcctacgaaaacttaagaaggaaaaaaaaggaattttactgaaataagaaaaattctaaagtagatcaaagaacatctcgctttccaattccacatctttgtccaaaatatccaactaccattcgcaccattctgcgatctttggaagggcccttaggagccctatcccttaccgttagccggtatctttttaccaaattaaggtgcatttcctagttgggaaaatgcctcatgacggtatctggggtctctacgtcaagtaaatatatgtcaatatatcgatgtgtcggcagagttgctggcttgcgcgagttaaagaagtaatagaacaagctttctgtaatcatcccgtcacttatgctttgtacatatcgtgtcatactgcgactgtctcaaggaaataccatgataaaatatctcttacaatcgaaaatctagcacgtgggagggtaagcataaactacccagaaacgcatgtatggactgcatttgcttcctgaccaaaataagtattatcgtcatataaaaaacgtgcatagtatatgtaacatcaatgatgctgggcgttgtttgccattttgtatttactatggcagtgtattttgtaacgagcacgtgatttacagggcgcagaaatgttgaaaatttagaaaaaagtaagataagcaatatcagtggcaccctgagctagtctctaacagcggggtgagaaactatttttgacaggagaatatcttcaatatcatttttactatttatcatgcctttagaatccatatgggccgatgcccctgacgaagaaccaataaagaagcagaaaccaagtcacaagcggagtaataacaataaaaagaataataatagcaggtggagtaatgaatccagttcaaacaataagaaaaaggattctgtaaacaaagtgaagaataacaaaggtaaccacgaaagtaaaacgaaaaataaaataaaggaaactcttcccagagaaaagaagccgcctcatagtcagggcaaaatatcgcctgtaagtgaatcattggcgataaatcctttctcccaaaaagcaacagagatatctcctccaccagtttcacctagcaagatgaaaactaccaaaacacaatccaaacaggataccgcttctaagatgaagttattaaaaaagaaaattgaagagcagagggaaatattgcaaaagactcatcacaagaatcaacagcaacaagtgttgatggattttctgaacgatgaagggagctccaactgggttgacgatgatgaagaggagcttatccttcaacgtttgaagacctctttgaaaatatgatccctcccatcacatggacacttttaagcacgttttgcttgaagagacattagtttacaccattataattgtttaataagtactagacatacttcaagtgagaaaatgaatcacacctttttcaatgattagcaaatctttattgccaggcctaactgaaacgatttattactgcgcaagaaaacaaagatggaaaaggctatgctagttcgattagttgtttccttattctttagaatattatatatgtatatataaataaatggctttcatcttatttcgaataaaaatgttttgggtgatgtgtattgagcatacacacttaatatcaaagaacaattataaagatgctatgaacggatgttatttttacctaactatgccttcttggctttgatacctctaatagcatttggaatgtatagaagtggtgtaacgacggctaccgcaaaaatagcataaaatggatacaggtataaagctgaccttggatgtctccaccatagaggtttagtggaagattggaagattttctgtagttgaataactttattagccattatttattattgttttgctttctgtacttgttggtttagaatcttatatcgagttctactattcatgggatgaataaataatatcatcttttatttctatccgccttttcaaacctgcccctaccaggccggatttctcggacgatgcgcggcgtagccaatcaagtactgcctttttttttttgctgacactatatgtatacgtgcatataatcaaacaataaagcaattgtaagcgtcagcaattctagctgtactaagatcgtagtgattatatgcgcttatatttacatggtatgaagaataaaatttgaataaataaataaacgtactctttacgagtacaaatctcaaaactaaaagaaaaaaagggttacatcttgtttccaaatagcgtctatagaaatgtagggtataagttgatgcaaaggtttttagcggtgtgtatgacacacaaatatttacacgtgagagaaaggaaggtaaataactgaaaagattactcctcctcctcctttttattctcttcaaaaagcttcattttcctttcattttgctccaactttaatagtgaaatctcttcatcaaaccattcttttaagaaaagtgttaactttctcatattctcaagcccctggtatttatagtccacatatctaagtactaactcgtcaatgcgatcctttatctccttgttatcaatggaagcagcagtcgaaatgtaagcaggccttttctcaaaatatttcataaagcctttgatttgtctaatgcaacctggagtaatcaggcttgccctatgattacaattccagtcttttaaaatcctactaaaccgttcgctttcatgcattcttgacgccaactttaaagatgtcatgtaatacatcatccactgtttgttattagaagtatccaaattttttctagcttgtgaaattaggtaacatgcatatttgaaatcacgggtgtgaaaacatatttgagtaagttgtaaatagttttgaactgaaagctccttttgatgtactcgttcaaattccttcagtttgaattccagttcttttaaatgttcagcagacaacttttcaaaagatctataattagaaatgatttcccatttcaaccataatatatcgacttttagtgggatatagcggaatctggtccttaatatcacatcaactacacgtgccaaaccagttaaagagtatctcaagcataatgccaaaacggaatacaaaaatgaaaattgaggcgcaatgccctccttcaaactattcgaaatcaccaattctgctccatatacatcattgtgagaaacttttttcttgaactcttcaaacctttcaaaatcaactgcgttgaaaccagataacgaagagtcttctcctccattgatctttctcgtatggatatgggcattttcttgtaaaaatgtgtacacccaagtgagacatttgctgtattggctcctttttagagtcacaagtaggtcatttgtaatttcttttgccagcattggataaacatttacggcacatgaccataattgttgaataaatgcgggccgtaatcgcgttttgccatcagtggttttaactacacagcgataatatttgaaaagtccttcgaattgattggtgttgacaaaatacctagaaatgcacaaatgaaacgaaccgtctatgctaatatcattatctctctggattttttccaagattacttttaaattctcgaaattgttagtagagacgtacgcttgaaccactgacatatatagctcttttcgtgttgaaatattattattaagtcttgtaataaatttatcaactctttccatcaatattgagtcatcaatgctttttgttctgtctcctttgatggaatacagagaatgacaaaattcaatcaactcgaattgcacacttgatgtatatcccgtacttaaaacaacgggattggttaaaaaatcgtttagctcatctgtattagaaaaacgtaataacattctgtgtattatcgcgagggttttgaacgagggaaggttagtcgaagaggattgctcatcaccacatttcactttcaaccagagataaaagatgtgtttcatactggacatatctagatatctttccatacatcggagaaactcaaaaagctgcttttcagttattggaaatgtatcaggattggtaattgcttgcgtgtaaaattccacggctagttgagtgttattactccttatgaaagagtttaatcctaaagatatcatttgtggctttactttgcaatatttgatatattctgcaaataaggtttcacagacatcaaaatgatgtaaattatgctgtactaccaacataatttcgatgaactgaccatatgtgcctttatcagtgtggcttgctaataagggcgtgaattgctcatatgttgtgtatatttgtccaatatcgtagtcccttttcaaaaagtgaagagaatttattaagatcagtaattgctgtattgaaaacaaaaccttttggttagtggaaaggctaattattgtcatcaaaatatctggatctgcactttcgaatttttgcttccacaatattccaaaatctttgtctttcactatattatattgattcttaagaatatctaagctgctggggcttttggtaatggagtccatccaatcgagtttattccgagactcatacacaccgcttattgttgaagaatcttttagttgcgctttaacccaatcctcaatatcttccttatgcttttttttgatcaactcagttgagtaatatcgtactttaaagaaaacagtgtgcataaccttgtttgattctctgtgaagtaatctctttataccactggaggatataaatctccgttgtaacattaagttctcgtaagcaattgtttaaatttaataggtagtgataaaaaatttgacgatatcaaagtagtggtgtaattaatagaatacatgaaaagttatgatcaacataaaaatgctctataccagatagaattttataaaaaaggaagagaataaaacgataataaaaggaaagacaggttaaacgattggaatgaggtcttcaagttacaaatctagaggaaaagtgtagacctggtgcagcaattgtaaattttgaacctttctgtggggggaggggtttctcaaagtatcagatagtattatgcacggtaaataaagcctaacaacaagaagtccaaacaataaataacaaccgtttctgatccttggatcgtatacagaagcttgttcatttcagttttttcattgtctcttccttcggtatgcctacctttctgaaatatatggttattattcgaagaactcgtaaggtccgggtaataattatgaaatgcaatagtaaaatataattattactcaactagctgtatatatacgaactccttcaacaaatgtacataagaaatgtttatcacaactatcaagtttaatcataaatagtttcataagtgtgtaattctgggctcacgctaaagtatattcctgacaacatagtttggcgaaggtttggcaatatctttatcaagtagttcatgtaaggataaaaaaaatgcgatataatagtggctaagggctcaaatgaggattcgtcaaaataacattcataacttgcaaagtgatgaattctctcaaagccatggaaattccacgtcgtatcctcaggggcatactgtagtaaatccaaatcccagttcttctgaggatcaaacctcttagctagagattttccagtatatgctgcaaacactatcggtataatatccaagtatcttgcatccggggtcgaaaagtattgatgattcatgatgtacttatcaaataatggtaagtatttggagcagaacgcacatttgcagccgttccacaaaaggtcacacgcatacatttcatatgaggtgatggactgcaatacagttggagctattattgtttccaacgaagttagctttggtaaaaccttttcataaagttttttacggcgaagcaagtttccatcaacagtatcaatgcccttgccattcaaaggtgggtcatgtcgtatgcttaacaaacgcaaatctttactcacgtttggtaaatttaaaataaacttattaacgaccaagtcccatttctcgtccatgtaatggtacccttttttggtgaatgtcttttcaatgaaccccagacttgttaaggaaacaaggtttcctgttatatcttgaagaaagtcatcatcacattcacagtcgtccacctcacaagaaaattctaattcaagggctttaagattggataaattaactacatccttaaacgcgcgtgaagataatctcatagaagtagcactcccatcaccttgtttgtgaacatgattaagcttcaaacggcgcagattcttgaagcggaggttcagggaatcaaagtattcaaagacccttaggcttgagtacgcttcgtcctttatttctaactctcctccattaagttgcttcattaacattacacccacttcagggattattacgttttgcaaatccaacgattcaggtaattgccattttaagcttttgaagttttgccataatttgataccatcaaatccagtttcgccatttactactctcttctttaaacttgacaggcgataatactttgctgaacataactcaaacaaggtaggatccttgatgtcaagactttcaatcacgtccaagtcagtgatttcattgaccaatctttgtaacagttgcaatccttcttccctgttgtgaaacaaatcctcgtcaatagtcagctgttttatacattttaaatgcgatgtctccaacaacctttcaattctatcatataaaaatatgtcattcttgtcaccggttttcagaacagatctataaccacttacataagtttttcccccgtccaaaaaccatttgtttgttcttaaaacaggattcttagttatatgaatattgctataaagacgagggattgcaatcatgtcatgcatttttttggatgttagacttaggcttaacaaatcattttgattaagaaataaggaggcatgcgagaacactatgaatatatcttgatcttggaatgccatttgtcagtattacttttgttatatcatgtgaacacaactgtggttttcacaatagttcaaattgactagagagttagtaaagggggtacaccttgcttttgtaatagggcacacctttaattttccatccatgaacatttttcaacaaaaaaagaggtggaaaaaattcaaaagaaaaatgacaacggtaaagaaattaaatcaagttccatcattgtatttagaatagaaatcgacatgctttgtaataggttccacaatgaatctcgtcactaaatccataagtaggttagagatgaatcagattatatgcaaagtatatatctgtacatattcattatttataattgggaataactgataattaggggatgaacagaatgtttagtcagaacattgataaaattctcataatcagaaggagaataatgttgaatcagttcttttaaaagcgttattcttgaaaatatttcagcattagagcaccagccgagtggggaatctttaaaatcctcgctgttgaagtgctccaatagagcactttttaggtgatgtatctggtctttgtaacactttgagatatcccttccagtcaattttatcatatttaatatatgcattgccttttgtagttcgttgatgaactggttatccttttctatagtaaatagacaattcttcgccgattcttcggcagcaaacatatcatattcatttagatattgaaacaactgtaaacacaactcttctaccacctcagaacttgtgaatacgtcaacaaacttttttgtgaatataagagcggtcacactggtgttcctgttatattcccagtctgcagtttgaataaagttcttattcaaataaaaagaagccttttctcttatttcagaatcatcgtcccataagaagttgtacagttgtaatagtattctgaagttcttacaactttctggataagcagttaaacattctaaagatgccaatctaaaatcttttgaacaagaatcggcgaaaaatccttgtaacaagttccatacctggtgaaaggtttgcgaagacaatttagcacttagtgatgaaacggcagcaagttttgtatcttcactattatttgtttttaggagatcagtgcaagtcgtcagggataaagtattcttttttcttgagagaattttcactactaaagctttagccataggcagcaaatctggaaccctgagtaataattgtagttgttcaagaaattctgagtttcttgtagtttcccagtgaaagttagtattcatgtactgcagtgtactgagctgaacctcataaaatggagaatacaatcctaataagcaaatatcatcgagatatatactatcctcatattttaagagcatgtctaagatttgtgcaagatatagctgtttgctaccatccacaacatattcgttattttcagcaataaatgtgttccgcaaagtgctgatataatcttttaaaatagaatcaggtatgtcgcatgtttccaatatacagcaggtcaattttaagtaggcctttttagtgataaagcacttgttctctagtagaagcatccttttcttttcaagtatcctttgaatcaactccatatctctagttcctgaaaggtattgtggtactagttgttgaagtgctagtaagtgtccatgtaactggttttgcttcgcaatagaagccaagtcaagtaattttcttatctcttcttcaaaattttccgacagcatatgcaatactctagaggccatatctctgatcttccagttctcatttgataaacattcataaacagaaacgttgaattcttttagaccagtatagccagctgtaggccgtaacctcagtagcacattaaggaccaagaaaatgctttcaatttgatatgattttctttcacttcccgaatattgagcaatagaactgtttagaatattcaaaagcagttgcctcaagccagaatatttggtaaagaataattttgcactaacgcttctgcccacttttccaaaaattctattttgcaaggaggtaaacagcatgatagaacagtttcttagagcccatatatcacagtcgaaattcaataaagctagttctaatgcctcagagacaaatgacgtacagtgtacagagagcttcggttcaacaaagattgcgtttatacaattaatagcattaacctgtggtaaatcaaactcatcttgatggggaggaattggtaaccttgcaacgagtagtaagttttcaaaagttttttgtaacaaaggtctccctttggtaacttctgcacttaagacggttgtgaccaagaaaggcaagcctcctgaccttcttgtaatatgttgagttttggattttaaagattttacactcttgcttaaaagttcttccagaatagcgggaaattcaagttgacaacgaatacaaaatgcctttagccccggtaaaacggcttggaaggcgccactatgacgaatagtagaaagctgaacaataaaaagatcgccgatactgtctaattgatctcttgttaaagggtatttttttaatattgtttcaagtaaatatgatgcttcttttatcgccctaaatgcgtgacttattataacttggtccggtacaccacaattagcatatttttcaggtagtattccatgggcagaatcatgacacactacatttctcgttgcttcccagctcttgagtacaagatttattaattttgagattatttttgaagtatcttgatggttttcttcagagttgaacttattcaaaatcaagcttagtgcagcaaagtgaggaccgattgaattttctgcacaaccaatgctgtcattttgcaaattttgtaccatctgcgctaatatatcaattgtctggtcaatgaagcttctttgagagcccatgactgtgaatatgaactcatatacggtagctccagcatcacctttctcatagtcacttaaaagagaggttgcagtccacttcaaagcatttacgtctaaggtatccaaaaaaagacctctagattcatcagcgcttatcattataaatagcatttctttagataattcgcgcacgtcagcataattactaaccaaaaggtcaatgagcaaccttaaaaatgtgacatcctgtaaaattgggatagaaaaaggatattccctcttattttggttgtctaaaaatttttgtggagtagatttatcaacaccagatttgatcagaatgtgcataagttttaatgaggtcacgttcgcctgatataaagtaccaggggccaaattatattttataaaattgcatagccaaaccaaaaaggctctagcgtcctcaacttgcgccaacttttccctctgttcgtccggaaatttctcagcctttttaagctttctggcatccctagctaaagagtatgcgcagtctctggttctaaatataaagtgtttcatcgaactgcaaaagtaatttctgcgttcaagttcagtgtccacgaagaacacatataggtactgttttatagttttgaagacgaagggacgaataggctttgacttttttgtggaaaaggtcagtatttcaaacacctgaagtttatactcatcttgctctatgagtttgttaacagaatctacagtggtatatttattatcacaaaatggttcttcttcaatccccaattcttggccaatctttaaaagtgagagcaaaagtgatgggtctttgttagacatacattctaggaaaagtgtgaaggccgagtttggcatatttttgaataatggaatcataatatacagattaatggatttggtgtattgtttgtcgtgaatgtactttaaagcacaacttttccataattgtatccattcttgtacaaaagactcgttctttttgaaatgcttttcgtaaatgtttaacagcaaactaacaatgcatttacctaccgaatttgctagcaaatcagagttcattaatgaaaaagagttatcgatgaaatgaggctttttttctataatataataaaggtcaaaatcagaagaaagggcatcaatcaagtaatactgaacacgcaacgtagatggtacttctaatatttcattcatccaattaaataaaacatccttcaaggttgacataggatatgtgattttcaataagttcagtagtttactgaataaatctctcaaggcattcatcagtggggctccaccatcagcccaaaagtcaagaacatattcaaagataatatttgcattcnnnnnnnnnnnnnnnnnnnnnnnnnnnnnnnnnnnnnnnnnnnnnnnnnnnnnnnnncaccccccgccgataaaaattcttgagagtcaatttttttgcttgcaattatttgatggctcctcagtaaacagatcgaaaaggtatctggaaaaattaaccttgtggactcatttaagttcggtaatccgtccttgatatactgtattaagtacctgaaatcatgctcaatctgagttaaaacagcatccttattttcattgttgatctttgctggattattagcaatcaagaattctttgacacggaaaagctcaatttcctgacttgaaaattgcacatccgtagtcattttttgaaactttcagtatgaagtaatgtgtgcctcgggaagctcacaatagtattgtcattttcctgcgatgagcattttctggtaaaaatttattttaacttttcattttcttttcagtctaaaaaagtaaattttcgatggaaaaaacggaagcactcatgagtgacaataaacagtatcgaaataaaaggtaataaattaaaaacgatgaatgaataaaacgtattcgcaacgtgctctttgctcaaatttctcgtgcgagaaaatttttattacgtctccttaacgtccgcttgaaagaaaccctagaaggaagattaaacgacttcttgaggtatttcatttttattctttttttgatatctatatataagtatttctatatagtaaaaagaaaaccctttcctatgatggactaaaaaatataattataaataaattatgaatagttgacgcattaaaagatattgaggacacttgttcggcctaaattaaatgtcatcaatatcaagttcttcatcttcaccttcctcatcatcttcatcagcgttaccaaattcaaagttaacgtcttcatcagattcgaaaccaaagttgtctgtttcattaattttggcgttttcaggaagttcaccttggtttttcagtgttctggcttcatctaaattatatttgtggacaacatcacattggtcatcttggaaatctcttaaggaaacaagaataatatcaccttgtcccatccagactttctttcttaacttacctctaatatgggccattctcttattaccatcaaagcaactggcttcgactcttccattacccaacatcttggtgatttgagcatattcttggccttcttccttataaataagttcacgctttggaccgtcagagtcgttcttacctcttctaccttttttaccacctttagtgtttttcttacccatgatgaactttgctctatattacactagtgcttttgcaagtacaccttctacataagtaaaggtttctttcagcaaactaaaattgaagcttttttcaatttttcactattacttcttgcggcgaaaacaaaaatgaaaaaaaaaagtgaaaaatagcgttcgtatataatgattattataagatctcattaacaatatgagaaataacccacattgttagttgaaacttatttgtaatttatcgtgctgtatatacatatatacgtaaaaggaagatcgtacttttatatttataatcgctcgtaaaaactataactgaagaataagaaagagaacattttgaaagtacaggagggaaaatgatcgcttaggcggctgtcaagtcatgaaggatggtaaaaagttcattgacaccattgatatgttccttggcataagtggatcttgagctaccgtaaagaatggtgtaaccaaattttaggttgttcttttcaacctcttgcttcactaatttaaataatggttcaataataggtgatgtcgaaccggaaacgcaaacgaaatctacctggttttggaaatgtttcttattattaccgacggacatcgaagaggatgttcttgatagagatattctgctattgtcagtaggactgacgccactgttgtaaaatttcatcaagaactcagcggcggctaaggctagccccgtctgttgaacaaagacaatatccttatgcacataagcgtgaatatccctgtcatcaaataaggtgtttatgtgcgtaatggcttccccaataacagttgggactcgatcttgatcttcagcgttttctgtatggaatctgatcatagaatcagcgattttgtaatatgaaccaggtaatctctcgactttctcgtcaaagatctttgccacctctttcatccaatcaagctcttccacgatgttgtaccacgacccattaactcttacgtaggcaccattctctgctatcaatccgatgtttagaacaccattgtataagccttcgaatgtattctttgtaaatgaactcaaaacgtaaactatattatttgaactcaattcacttagcaaggatagcattctggacgttggaggttctgaaatcttgaagataaataaatgctttttggaggctttgtaatcagcacagaatttttctggagccaaattgaaaacagtagacgtttcttggttggactcccaagcattatttatgtattcgaagcactttgtaatccaattatccgaatcatgttcaataacagatttgaataattttttccacctacgccttttttcttctggagacatttctaaacttctcttgatactttgtgctacatgatttatatcccatgggtttattaagatggcaccttcctttaggacagaagaactaccagtgaattcagataataatagaggcgcatttttttcgaatgaactgacaatgaactcatgacatgttaaattcataccttctctcagcgcatccacaaggaaaacgtcagcttcacaattcaatgccaaatattgagcaaaatctaaatcttgatgcaaaaagaccactggttgagagatactgatgttcgaagacaaagaattgattctatcaacgacaaccataatttgacgttcgtactcaggatcggaactcttaccgatgcagatttggatcaaaacaactttttcgatgtattcagggttttctatcaaaaacctctcgtaggctaacatttttttctgaagacctctaattctgtcaaactgatcgcgacaaacaatcagttttttattacgccatctttctttaattaattggcgccattcaagtacagaaccatttctcaactgcgatgtcaaatggtaataatcaataccaattggcgcatacatcacggaaacaatattgcaatggtatttgacttcatcattagagacatccgcagcaagcaatctgttacaagtttgtaggaaatgtcttttgtattctttagtttgaaacccaacaaagtttgcaccaatgataccttcaagaatcctttctctgttagcaaggcatctgaagacctcactacttggaaatgatacgtgtaagaaaaatccaattttagctttaggcagtttctctctcaccatttgtgggacaagcatcaaatgataatcatggatccaaattgtgtcgccaggtttgtaaacggaaactattctatcagaaaacttttgattcactttttgatagtagtcccaagaatggtcttcaaaagcctttgaatttggattatctggaatttgataatgtagagtgggccataaaatctgtttggcgtagttcttataagcacccttaaaagtaatatcgtccgtgaccactggaaaagaagagaaatcctgttctaatttctttgaaatcttatggcaaacttcgtgaggaagttcgtcagtagggattcccattgtacctacccaggaaacaggttctttcactgtcttttcagcaactgcaatattaactgcatttttcaaggatccgttccctttgtcactgtcgactattgtccatggcaaatgtttgaatagctcatacgagtttctcattagagatgctcttaactttgcgttattggaatagccaccaaattttgggacgttgtatttcttagtagcatcggtctccaaatcagaatcaatgtcatcctcactatcagtgtcttcgataaagttatcctgaaattgctgtgagtacctgagattagaactcgaagaagcaatggaagagtctccagcggtgcttccggaaactcttttcatggaaggcaaggaggcttgctgttgaaactcttctctaacttttgcgacatctacaacagcaggatcgacatctggaacgcttttagagacgggagtgattacagcactcttggatgagcttctgaccctgggtggatgtgaatcaaatgacaaattgggatttttcataaggctggagctcaaatcgttgtggtgagccgatgaacgactagcagaaatagacgaagcagaagcttcctgggagggagaacagactctagcagacggagcagaaaagaattcctcgactgaaggccgctgggcagttgagccagaagaaactgggttattagctggcggaataccagagtttgctgcatgagtagcattggcagtcagctcttccaggaattgctcggaggaaagcatttccatctcattatgatagttaactcccgtagcaggagagcccacattggccctttgtaagggttcaccgttaatttgcgcctcctgaggtaagccaatataatgagagcttgccgaagttacagaactgcttctttcttgcttgttgttgctcaattcctggttgttgcagtctaccttgatcatacttgattcaaccagcttagcagtatccgagttggtgacatcagcctcgaattgaggggtatatggtaagaataaagaagcgacgataatagtcattgaggttgcccgtggttattagtctgtggttttttgaataggaagcaataaattataaagccaggacctgcaataacgtttgtactgttttattgtgataaaagatgaagcggaatagcaacggtacttaaaacttatgtcttagacttaatactattgaatgtttgctcgtccacttgatgctccctggagttgccgttgctgcgtgctgaaggggattaattaattccaggggcaccgcgcgaagcccaggaggacaattgattacgtagggaagaaagggcccttttagaagactggcaattgcaactctatcgaggttaggtgttagactacgctgttcattgaggaagtagatgaataaacttgttgatgcccactgtcatgttataaccgacccagacaacacattctgcggtgatgatggagggtcccagggtacgttgcgttgcgttatgtcatcaaacccatatgactggaacaatttgaaaaaattggctggcagaagcacaagtaaaaacgatatatgcgtgggatttggtgtgcatccttggtacagccacttattttatgtgggaagtcggcgcgacaaggtttctcactatcaagatgtactggagtataagaatgaagaacagttcgacagtttggttcaggtgcttcccgaacctctagatcttgaagagtatataaaaagagagtttaacgacactttggtcagtgtgattggagaaatcggtcttgataagctcttcagacttcctgcaaatggtttctacatgcagaacgagaaggcaaggcttacgacagtgaaggtcaaaatatcgcatcaagaaacagtattcaggcgattttgccgactggcaaggcacacaagcaagcccatctctatacacgatgtaaagtgccacgggaaactaaacgatatctgcaatgaagagctcttgacgtatcactctgtcaagatatgtttacattcgtacacaggctccaaggaaacgcttctgggccaatggctcaagaagtttcccccggatcgtatttttgtgagcctatccaaatggattaattttaaggacccagaagagggagatgccctggtcaggagcttgccctcaacttgcatacttactgaaaccgactatcctattgacaatccagatccgtcataccaaaaggcccttacagagcagctgcagtatttgaatgcacaaatcgcacgagcatgggacgagacactggatgcctcacaagccgctttgcgtgtatacgaaaactttcagaaatttatcaagtgaaacgcttttgaggtggcagcatagcactgtaatgagatatattaagtaggcttgctgtataccatttcttgctatgcatgtgtattatcaaggcaacgccgttccggaagggaaaaagcgctcttttttatatactgtgaaattttcagattataacttagaaattatataaaagcggttgtgtatctattgtgataatgcaattcctttatagtttagcaaatcgaaggataggtatatactgagtagtaatggctaggccagttaatacaaacgctgaaacggaatcgagaggcagacccactcagggcggtggttacgcaagtaacaacaatggcagcagtaacaacaacaatggcagcaataataacaataataacaataataataataataataacagcaataacagcaataacaataacgggcctacctccagcgggagaaccaatgggaagcaaagactcacagctgcacaacagcagtacattaagaatctcatagagacacatatcaccgacaaccaccctgatctgcgccccaagagtcacccaatggatttcgaagagtatacggatgcgttcctgagaaggtataaagaccactttcaattggacgtaccggacaacctgacgctgcagggatacttattgggttccaaattgggcgcgaagacttattcatacaagaggaacacacaggggcagcacgataaaaggatacataagagagacctggccaacgtggtgagaaggcatttcgatgagcattccattaaagagacagattgcataccgcaatttatatacaaggtaaaaaaccagaagaagaaattcaagatggaatttcggggttgatcaaacgatgaggcagcccttttgtgtataagttatgtaaacttttaaggtggtaattgttaaaatggacagtaacacttgtttatttgctagtattccatttagtttaatgcctttttgtatacggtgcgggtagctgtcgcgccattttaaacgatctaatataactgaggtgggcctgtcattgatgcattgaatagacaactcatcaacctatttcttataaaaggcgccataaagcattacaatctacgatcgcgcaaacttttttcttttggccatggaggattcgagattgcttatcactttgattcttgtgtttggagttatatttctgaaaaaattcttccaaagtaatcagcatccctcagcacaacgcttatccgctacaggtgtaaacgcacacggacgtcctcagggccccacgcagaatgccttgagaaggactggtagagtcaatggaggtcaccccgtgactactcagatggtggaaacagtgcaaaatctagcccccaacttacatcctgagcaaattaggtatagtttggaaaacacaggctcagtcgaggaaacagtggaaaggtacttgcgtggtgatgaattcagctttccacctgggtttgagccctccagggcgccaatgggggccaatgcggctgttgataataacgctgctggtggcggagagtttaacgatcccagaaagaagaacatgatttgcgctgagaatctactcgataaattccatgtggatcccaatgaagatatgagtaatttaagctttaaggacttagacattgaagagagaaagagattgttggtttggcaagccagaaaaaatttggagacaaaattgcaaagtgataaagatttgcagagtttgctgacttgaacgcttaagtgcttaccgggaacacgcaagtgtgcccataatgcgcataagtatatctttgtgtttacttatttaaaatgactaaataaataacccaaaaaaaggaagaaaaaatgtaattattaagcattggaacacggtattgctgccaacttggcaaattgcccgaaaaatgcctttattggtattgtattgtctaacggaacccagtgaatatcttccttgcagttcattagacgctctgttaccacttctaaatcttcaattcggtctcttttgtaaaaatgaccagtgactatatattctggaaagagagtgaaagtgtatctgtttggttcgggtgtggctttgaaataaacctccaatggctttcttctgttgtggtgggccgactcgatgacggcaaggtctgtgacttggaagtgtacgatgcacttcccaggctgttcctgataaaaattctgtgagatatgctgtactttcttctcagaatcaaacgtgcgagtgtcattgtttgaccataccttagcgatttcaagcgcagggatatctttaccgggttctgcgcacggtatatacaggggatgttcatacagcttgggtctgaacgttcttctcccctttcgccgccttaagtacttgatgacctctattgataatagacgatgagatgccgtgcaaaggatataaccaatttgtcttggagtccgtcttaaatcaaacttttgcgaagtgctgagagcttgactattgttctttcgtaccatgtccatcaccatttcaagttcctgctctcttggcagcgctttggtgaatggtcgtacggggatcgcagaccatttcagacgtggtagatccaaagaatggaagaaagacttgaatgcatctatttggtgtattctatcatcatatatggacaactcccgcagagagggataatattccaagaaatcccgcatcagctcttttttatatttgctagtatactcagaaattgctcttttttttaggcaaactgcattgaacctaaactcatttgctgagcatttccaatggctccttgccgtctgtaaagcatgcccaatcaacttatggaacttactttcctctctgcccgttaaaacgatcgagatagtatccttggcggaatatgactcctccgccaatttgacgatatccgcattccacgaataccttctcggtttagtcttcgagatctcaatagcggcctgcagaaaccccggctcactccaccagcctccattcggtaacgtgctcgatgtcaacaaatttagtagctcacgtgtatacaattgctctgtaggacccggcgttgcaaataatgtattgtcgaagtcgtatatgtgcaatttcgtaatcgcatgctcaggaacctcaaagggcacggccaactcgcaagcgcaactattccattttctgagcacacggtgattgccacatctgctggacatctcccctttccttcgaaattcttcaaattcttccattatactcgtttgggttatgcagacaaacagcacatatgataattcattttttttcttccattatacgctatagtaatgtaagacctgatctacgggttcgtttcttctatttccgttacccgccgtgcaccacaccaccgctgcggttccgtctgcgtgagtcgctctgcgcgaatcacttcccgcagctgacatcacaggggcggcctttcctggctacgattttttagcgggaaaggcacaccctttcttctcctttcgggtataaagtttcttctgtgtggattctgtgggccagcttcggttttgaagttggaaaaaaattcttcatctttgttttttatcgtggaaaaggaagaaaatacttgatagccaacagcaaagccgcatggcttggcactcgatgctgatgttgtcccgtgcctggttgtataatattattattaatggccatttcgtaatcaaatttcggtttgttgtttttttctatttctttttcatcttatatatattaattcgtatggcttttccgtttctttttgtttttagtaatcataaggttacggcttagcagcaagggcaagggcaaagggacaaaatgaatagtactaatagtactaatagtactacaacagctaccagtacaaacacgtcaactcaacaagtcgttacggctttggtaagtaatggtactatttttggtgtttttgtcatagcgttcttgattttgcgtataaaactaaaaaggatttatgagcccaaatcctcattcaatctgattaatgaagaaaaaaagccagaaccgctaccgcggggcgtatggcaatggctgaagccgttattgaaaaaatcagacaattttgtcattcaacaagccggtctggatggatatttctttttgaggtatcttttcatcattgcaatttactgtgctgtttccatgagttatatattccctattttgttgtcgattaacgccagtaacggtaaccatgaaagcggattgaatcaattggcctatcagaacgtcaagcaccgtggtagatattttgcacatgttttctgtggatggattttcttttgggggttcctttacattatttacagagaattgtatttttacacctctatgaagcaagctgtactagcgtcccctcgttatgctaaaaaactatcctcgagaaccgtgttattccagactgtccctaagcaatacttaagtgaagaagagttttctaagttgtttgatggtgtgaaaagagtctggatcgcaagaggttccggttcaattgaagcaatggtcaaagcaagggacaatatggccatacaattggaaggtgctgaaacaaaatacctgaaagcagcattgaaaaaaattaagaagttaaacaaaaaaagtccgcaattatctgtctctgataatattgctgaatatgtccctgacaagaaaagaccacatcataaaattaacaaggttgctaaattcttttttggtaaaaaagttgacaccatatcctacattaaggaggagttgcccaagttaaaccaaaaggtgaaggcattacaagaagatcatgaaaattcatcccctttcaactctgtttttgtggagtttgaatcccaatatcaggcccaagttgccgctcagatcaccacataccatgctcctcttttcatgacgcctgcgtatattggtattgagccatccgatgtcgtttggtttaatttgaggatgttctggtgggaaagattaggtagggaagtcagtgcggtttcagcaattgtcgcgctagtaatattatgggctttcccagtggcttttgttggtatgatctctaatattacttccttgactaatgaagttaaatggttaaagttcatctataaattaccaaaacaactattaggtttactgacatctctggccccaactgtggcattggccgttttgatgagtttcttgccgaaatttattaggggtatggctatcactcaaggtgctccatctaagcaaaatgtggaatatttcactcaacaagcttatttcgcctttcaagttatccaagtctttttagttaccactctatcctccgccgccacttccacagtaacggaaattgttaaagagcccacgaaggctatggatctactggcttctaatctgccaaaagcttctaattttttcatgtcatacgttattctacaaggtctgtccatttcatcaggtgctcttttgcaaattgttccactaatactcttttatgttttaggtgcctttttagatggtaccgtcaggaagaaatggaatcgtttctgtgggctatccagtatgcagtgggggacaacttttccagtttatacaaacttggcagttattactttctcctactccatcatttctccgttgattttattatttgctgccgtcgcatttttcctattgtatatcgcatatttatacaatttgacttatgtctatcaggaatcacccgacgcaaggggtatctattatccaagagctcttttccaaactatagttggtatctacatcggtcaggtatgtctattaggtctttttgctgttggtaaaggttggggcccaatcgttttacaggtaattggaatttgtgttactgtccttgttcatttacatttgagcgctgcatttgatcatttatcaaaggttatacccgttgataccatgaaaccgttagatggtgtatcagatacaccttctttcaaaaatatttacaaaggcatagaaagtacaaaggtgaagaaaaatgcttttggtgcaaatattgacatggacggaatcaaagaattacctgaatttccaataaagaaatatcacaagaggagtgaatcagtcactgagcaacaagttgaaaacagcctatttagtgaaaatacattcgaatatcaattcaacccagcaaatgaagcaaatgcagatgggcacgctataaatgcagaaaatgtaattgaggacgtgccattattagcagatggtgatacaatgaaaattcctccggctccatggtggaagagattcttgaaacctcacatttactactcctataaggctgtaaagagcagactgccagaaatatacggtttggttgatcctaatgaaagagtcaatgatttcgatatctctcatgcttacgattatccagctgttagtgcacaatgccccgaattgtggattcctcgcgatccttatggattttccaaattgttgatttcagacgtttctggcgttgttgaaatgaacgatgaaaatgctaccatcgatgagaatttagaattcactctgcgtgacgtaccaccatcatataatgatgttaaagacgaagcgacaggtgaagcaaatggcgaatttgacacagctagtaaggaaaataatccatttgcggacccaaagtataaggaagaagagagtcgttcggcagtctaaaggttaaacattatcagaaattatctattcctatttgtttagctgttatcctctgatggttgaattgtaattttactaagaaaaggagagaaaaaggacgtgcatatattcttttaatacatttaaaatatgattctaatcatttcttatataatagtgtatagtctaatcattcatcgtgtatagtaaccctttttgttttttatgcaaagtttttttgtttttggcaatctatgaggtttgaatattggataaaaggaactccgcacagtaatacggagcagtcagctaatttaaccagcactaatagggagtacattcaattggaaactttgattcgcttgtatgcatgaaaagcaaattcccttctaaagaaactactgaaaaacatgaatttattacgaatgaatgctttaacaagcaagactaggtcaatagaaaggttaaaacaaacattgaatattttatccattcgtaatcatagacaattcagtaccattcaacaaggcagcaaatataccctcgggtttaagaaatatttgacattattaaatggagaggttggttctttttttcatgatgtccctttagatttgaatgaacatgaaaagaccgtaaatatgattgttgaagtaccaagatggacaactggaaaatttgaaatatccaaagaacttaggttcaatccaatcgttcaagatacgaagaatggcaagcttaggttcgtgaacaatatttttccctatcacggctatatacacaactatggtgctattcctcaaacatgggaagaccccacaattgagcataaactggggaagtgtgacgtggctttgaaaggtgacaatgatcctcttgattgttgcgaaatcggttcggatgttttggaaatgggttccattaaaaaggtcaaggtattaggatcactcgctttaattgataatggcgaattggattggaaggtcatagtgattgacgtaaatgatcctttatcctctaaaatagatgacttggaaaaaattgaggagtactttcctgggattctagatgcgactagggagtggtttagaaagtataaggttccagcagggaagccattaaatagtttcgcctttcatgaacagtatcaaaattccaataaaaccatccaaactataaaggaatgtcacaattcgtggaaaaaactcatttcaggatcactccaggagaagtatgacaacctgcctaatacagaaagggctggtaatggtgtcacacttgaggatagtgttaaacccccttctcaaataccgcctgaggtgcaaaaatggtattacgtataatatgaaaataataccttcgaagaaaatgtttagataaaggttccttgtatataattacgtaatctctgctctctcgaatgttggctgcttgatgtatgtgaacgtttggaaagaaacttgagttcatattcactgctaaaatgacatcccattagaagttcgtctttctcctgtttggttagtctactcacctagaaacatcttgcggaaatcgtcattggacatctgctcttgtttgtcaggaatttttttcttcacttgaagatttggtcctttttccatcacgtttatacaactaggtttgacgtatttcatgttgtgattctgttgattgttataatatcttttcatgtcattaatagtacctgaacgtatcacctttccctgaaattgagatccatttagtatcattagcatttttgctgcaaacttactatctctaaacataacaatggcgccattgaagtcgctaacgagaaatattttcctaatatctttttcattgacgtgtatttcttcctgaagaaattggcagattaagcttggtgacaccttatctgaaagtggaaataagcatattagtgtttctagttctttgctgttacgcgatgcgagaagtcttttgacttcgtttctttctaagaatggttttttatcagccaaggaaacggaaatttccctattacctaacaaacttctattcatttgaagtgccctttcagcagaatctttatcttcaaaaaccataaatgcacaacagttattgaaactgtgctctttctgtccagcaggtatgttgattttttcaatggaaccaaatccctcaaaagagtccctcagaaggttttcgtcgagcaattctgtacttaggtttcgtatcataatctctcgcccctctagtgtggcagaatcggtccgtttcgacttttccagcggattggaaactttagtaactaaagtataaccttctattttaagtccattcaatttttctacacaatatcttccatcctctttagaagtaacatcgatgtaagcgaaccttctgcttgtattgaatcgtaaactgggaagccgtatactgagtgcaacaacgttaatatcttgcaatagatctctaatatttctttgagtataacttggggggaaattcgtcatccataatgtgcattctgttaaatgagatactataatttcattttgacctacaactttgtgtgttttggttattgcagcgagggctccatcatacctggcaaattcaatacgtgcaaaacgaaagttcttcttcagcgaatccgcaacatcaacgtgtataatgggcccacaatgtttgaagtacttatagactttgttttgattatagctcttaggcaaatttttgactaatacagttgtcaattctctatttcttgttaaagcttcgttcgccttcttagaagttaatcctgcggctgctggtgatccttcatccaatggtcgttttgaatctggtctagcgtgatgtccatactccattatcacagattatgaagtgaatatgtgggcttgtttatcgctaatgattctcatataataaatataaagggttttcaatgttgtagtaaatctgccattttgaataagttcccgcctgaaaattttttagcgatgactttaaaaaagacattgatggactctacaattcattgtaataatgtacatagaaaattgaatgatacaagcggaaatattatcagaataaatcggacatggatagcaaagaatatctgatatcatatggttggaaagaaggagaagcgtttagagaaggtggtttgaaaagacccatactggtaaagcacaagagagataagaagggattgggtaatgctcctggcgggaatgatggcgaagcatggtgggaaaggctatttgatggacatctgaagaacctggatgtaagcactgattcgaataatggcagtattaaatttactcaaaatgaggcagttgctactgctgtatcgaaaagtagctcacctctatacaggtggtttgtaaagggagaagggctgaaaggaactatttctaatcttggtaaaaaggaggaaaccaactttgttgtatctagtgcaagttcgagtaaagggaagaagagaagaaggcgtgatgaagatgataataaggtcaagagaaaaaaaatgaaaaaagataaaaagactagtaacggcagtgagagtaagaagaagaagaagaaaagcaagaaggagagtaaaaaagaaaagaaaagtaagcatagcaacgatgaaggtgataaatcgaagcataaaaaatccaaaaagtcaaaaaaacataaaaaggaagaaagttcagcaagaagagatagaaaggagcatatatgattatcatagtctaatatgtaaatatgtatccgtaaaagacattcttaaaagtttgaatttatgatctttttatttttgtatttagtctttgttttcgaacttttattaatatcaaatttcagtaagtaaattaaaaagaacatctttaaaagagtatatttattgttacatatgttgatattaaaaggagatgaatatttcttaatggaaaaaggtaaaaaaagattttttcgttcatatgttcccattaggcagttctatgaggcagtcgtccaactcgtaatcagagatctcattctcatcctctaagtagccctttacctgaaagaatgttcttttgtttaaagcatcttccgtctcttcgcgatttaagcgttgtagcttggatttatcctttgatgtcaaccgtttatccttcaataacttttctacaggtatgaaatcttctcttgttttacttaatagctcctttaagtatgaactggtcttttttggttggtgatacttttttagaatttgtttgggcagtctgaattttctctttttatacttttctgggatatcgttatatagctctaatgatttcatgtagatatcagtcatatcctcgttcatttcacaacctcttgaaatcaagtcatgatatgtgtatttaattcgtcgattggcctgcatgggctcgtcgtctatctgattcgcccttatattattagaatgcttatcttgccttacatcgaattcgttctctttggctattttatcatgcaacccttcgaataagctgtccagtttaactaagatattccgggatatttcgtttggaatgttcaattcatccacatctagagttacatcatggtccgaggcagacttagagagaaatttttgccattgagcatccagctcaaccctcatcatatcagaggcgtgcattaaagccctatttgagatctcccccggctgtacgcttacattttcaataccttccggtatatcttcatacaatttgtctacactagggtcaatgattgtattgggattaggccagctcgtccagttatccttaatttgggtcttcacaaactggtttacttcataaaaatgttttttttcatttgccttatacaatagtcttttcaagaggtacgcagagtataaatgcaacgaaaggtcgactctgtgcgagtgttctagagaatctaataattcatttgcagatttcaaagtctctttatcagcggttgtagtggtaagctcagatcctcgtataatatcttcgataggagcatcgatctgagtttcaatttgactttcttcgtcaagatcactcatcaaaaccccacgtaatgtttgttctcaaatatatttcgtcgtcccgaaatcagcacagttttataatgcaactgttaaatgtctagagagaaaaaaccgccgacacatctatattttcaccctttatggctaaacttgagtgtgattcttgcatctgagtaatcttcaaacacgaaaggcctttttgtttattttgtagaagaaaaatactttagtgaaaaattatggaaagtagtagaaatcctctcaagtgaagcatgacaaaaagaaaagtaagaaaccttaaaagacactaatagttgatgaattactatgcgagaactcacgtaactccaacaataaaaagctatttacgtatactgattaaaaaagaatacaagaaaaatttattctttcctatacaaacaatgataatcaaatggtccatgtcagttctatagttcatataccataggccttacggtagttttcaatcgctgatttttgctctggtgatagtctatttcccataaattgtaccacttgtgtcagtgatacaatacttagcacaggaacgttgtatctctttgaaacagattgggtagcacttgttctttccggatcagattcatgaatcacttcttgcctatctaaagcaacaatacaacccactaccctaccttgagcaatactgattatctcaaatgcttcattgattgcagttcctgcagtcatgacatcgtcgataatcaacaccctcttgtcttcaagcgatgctccaacaataataccaccttcgccgtggtctttaactttctttctattaaaagcatattgaataccttgaaatttagtgcccccgatttctgctagtttaacgcatacaatagcagccaaagggatccctttgtaagcaggtccgaaaataacatcgaatttaagctccgattgaatgatagcagttgcatacgcggtggcaaggtttgccaacagctttccagaattgaacaaactaagattgaaaaaatacggcgactgcctgcctgaattcagcctgaatgacccaaatcttagtgctttgcattctaatcccagttcaaggaaagttttttgatattcttctaaacttgtagtagatgcagacattattggattatgttttattattcttgatggctctaggtctcgactactttgcgtgacacttccttagttcttaatctatataaaagagcctgtgatggccttttactctagattaggaagcgaaggggcctttcccgaaaggttatgactcccttgaaatgcatatgataattaaaaccaaaaaatgttgggtgattctgaaaggaaatgctgtcatgtgagccaggtgtagagcaggttagaacagtttatattacatagtctgaaaggcacgtgagaaagtgccataccattagccgaatacgtgaaatgtctaaaaaaatacaagtgaaagaataaagtgctaaaaaaactatcaggctgtcagaaggcaatttagccatatgtatacatatatatgtgtgtgtataaacctcatataaggggccccaatggtttatctaaaggataccctattaggacttgtctgtcacacgcaaaacttcaaatgacataatgatgagcacttgtcaaataattgagtaacttcttcgatatctctggtatgtaaaaataagtatatcgagatgagcgattgtatctgtatagaggttggtttctttttcttacctttctctttttatttttttctcgaattggttcaaaaaaaaaaatggtttaaatttcgtaaaataagaaaaatgaagggaaggtcccacccggattcgaactggggttgttcggatcagaaccgaaagtgataaccactacactataggacctttttcttctgttgttagtgtacactaaaacttccggttttatgaaacctttttaaggaagatggtccctcttttaacaatatcgcaagcaatggatcttgaactggtacggaaaaccgtatatgctaacaaatcttaggtttctacgtctgactaaagaaagaattgtgagtgaggtttatagtagaagctctcctcatgactttgggctatgtaaatgcaattgatgatttgcgcaacacagatacaaattttactttattcttcgtgcctaaaatggaccatcgcttcacttactagccgttgtttactaagatatagttgtatacggtgtggaggatgataagatcattggaccaatataactatataaatgtcggcaccagtttgatggaacctcgaatgcaattactaataacggaatggattaagaaatgattaggtatgaggtactcttatagtatgtagaatttctgatttgcttatgtgttcattttgaagagaatgtgaattttgagataattgttgggattccattgttgataaaggttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacacatttattctcgaggagaactcttagtatattctgtgtcctaatattacaaaaagtcaatgagagtctaggaattattaggtaacttcactatgctcatcttgattcctgttctaacgacagtaacacaggatacggttagcatttttttgccaacctgatctgtgaaagaaaaatgtacctgtcaattcggttcttttttgaggccgctttttcgtatagtcgtcatcgattggatattcgtttaagaaataacgtgcttgttcatcgatttcatctatgattccatttcatgtgtatgtatatatacgtagttacatataataatataaataaagatttgaaataaatatgtcgcagaaaagaactttgctcaagatttcattgctcgtaatgttgtttttcctaggttgacaattttggacgaggctgaccaataattattcatatttcattttggacaatggggcatcggggcctaagtaggtgccaaaaacttcgtcccaaaaccaggatgtgacgccaaatcccagttggtagtttttataatgatgttccaggtgatattttttcaacttacgcatgaagggaggcaatttagagtggtgcaagaagaaatgacattcgtcataacagacataaccgaaaagaccgccagcaaaaccagcgtaagcccaataaagtggcagcagagcaaataccaacttgtaaaatggagcacaaagaatgacgaacagagtaggtggcataactaaacggtacttgtccatgggcaagtaatgatggcaaccatgtagtagaaaatgtgtggcgaatgcgatgttactttcaggtaaccaatcatcgaaatgaaataggaaacggtgaagaccgtattcaatcaaagtccaaacgaagacaccaacacagaacaagaaacatgcaaatagctggttcatgttcttcaaagcaacacccatgtggtacacaactacaggcaaccaagcaactggaacaacccaccaagctgttttagttaatggttccaagaaattaccaaatagcggggcagaccccttaccgtaatgtcttggtctatggatttggtcaacgtaaaaatctttcttgaaatcactacgcagaatctgcatcagcaaaggacggttcagatccaaaaatttatgctttttgtagtcgttactgtagtccgtagcaatacttagtttctcctcggcgggcaactcctttacaaaagtagtggagtcaaactcagtaccatcagctgacaactgcacttcaaccttatggttcttgttagtcaacaatctcgctgcctcttcgtcagttgccaagtaaccaatcaaatattcgtcctcaaggatttcatacgcggagtcgctgtgttcatgcacatctgagtctttcatgatctcagtaatgtccttaccagcatagtccaagatggactcgtcaccaccagggtgttcgctcaaaaacctggtcacgtcataaatctttctgttttgataagtgacccagcagtcattggcagtattgtgttcttgtaccgtcttttttgaaaacagttccaaagtcttggaagtattagtcgacatcttcgtactagttttagcttaccaccgcttttagtgcctgccacgataacaatagaaaaaaaaaactaatcaaagacaatagacacaatagcttctactatctaatacctctgttcttatacggttctaaattgaaaaaaaaattaactgcgaaaagatgtcacacgtcagtaaatccgcgcaaaaacccgttatatttccgacgtcgtgcggtagtttctgcgcggaacggccccgcggaataggcacattttcttccggccgcagaaagctctctttatcaaaagcaagactgttttcggctattgtattatgagaagtttggtgtttgtccaactttccctgttgtcctgggagatattctgtggggaacgtagctttgtgggcatgaaagctatcttttcgtgtatgtacgtgtgatgtgtatatgtctatgtatgcagcgctgaagccttttcagggttgttgttgttgttgttgttgttgttgttgttgttctttgtcgtgggctacctgctccatgtacagagtgtgattaaccaagttcagataagcatacatgaagttacttagtaatacctgctcgcgcagtcccctcttcgaattgctcaatttcaagtgactcagccggtatatggccctttcgacgttaattggtagacggtggtcgaacatgataaccgtagacactgtcagcaaaggcagtgggaacccaaaggcactgtctgtgaattgaaccggggagtttggtttgtcaggttttttgacgtctgcaaatgtaagctttcttgggggcaatatggaggtatgtttcaatggtggtgccgctggagcctgagtttgagctgaagcttcaactggggctgaagtttggactggggctgaagcttggactgggactgaagcttggactgggactgaagcttggacttgttcttgagcttggacttgttcttgagctggagcttgtagttgagctttttgctcatcggtattctccttttgggcgtgtttggagtgttgttggttggaaatttctgtcgtattgctcctcttcttgttctttttctttgcctcctcttcttctctgtctctagagttacttttggtactacttacactaacggccggctgtagttggggcaagctctcggaatcgctttcctctttcttttctatctctattgcgccttccaattgtggttgtaatggtatctgctgctgcggctgagaatctttaagggtttttacgcttattttttgggaaccatgacggctgtgatggtgacggtgaggacgagggcgattgcgcaacacaatgggttcaaccggctcccttccacttttgttaccaagctttttggttttcctcacacgaacgtgcacggcatcgttatttggtattgatggtgacgatgatggtgacgacgagggtgatgatgatgcatcatgcttgtggtgtggctttcttctgaataggttcgcaaaagttttctcgattttctgtcttgtctgtgatgtggcggtggaagtacttgaattgttcatttcttctttatttgacacctccgtcttctcaccgccattaaatagagaaatataatgttttttggaattgtcgagctccattctttgtgaatccacgttttcttcattttcatcgtccccttggttttcttcgttatcgtcttctctgctcattttattgttcaaccatgtccatccgtttcttcgacgatgtcgcttcgtttctttgttgtcatccgttgcgcttggctttaccatgtctgttgttccctctcttaactctaagtcttgttctactgtgtcgtttcgaaccttgacgggtacctcttcggcttctttctctattcccatttcttgttcccactcgccactagactgtctgtaatgattataaatgtcttgaaaatcaccaattgacccaggcgaactcatattctcagaatcctcatcttgctgtctaaaaggggatttgtgcggatctatttcgacctttattgtattcttggtcaaatttagacgttcttcgtcgtcgtttttcatttcatccacactttgttctacttctttttcttgctcttgtgacctgattcgataagtgttgaatctactccttctcagtgacgatcgttcaggccatgtcatggtattattgatgggcatattggaggcaaattcaccatcatccaaagtattcgcttgtgaagttgaaaaaccaatatctccttcatcataatgcccttccggttgtggttgatcttttttatctgaatatgaaccagccatactaagagttctggctaatgtaatggcatcattgtcggttagtcctgcactatttgagatctttgtcagttcttcagttatatctcttaacgacactggtctctcttttattttcgaggttctttcttcgactttatttactgtttcagaggcactgtctcccttattatcgtcatcttcgttatcatcaaactctgtatatgacctccgcaatgttgaaggccttcgtattagtgacgcgtttccatgccttgacagccccctgttcaagttgatagtgttgttctccttattttcatatgattgtgattctttatcctccccattatcctcaatatcgttattttcgttgctattcccatcattatcttcaccattgtcgcttagttgtatattttgtaaagtatcttgtacaagctctaggaaattatcaggcttaacgttagggtgttgattggcgggaacccataataagtttttctttaatgcgttagcatttaatttcctggatggagagtgaacacctttttttatacctaagtagtaaccttgtttagtcttattggaggattctgtccctgagttacccctcccatgcaagttctctagcggagttggatcgctatatcgtgtgttattaacggtggttgtgtcacttggcattgacgcagaactggatgtcgtgccagaccatgatcgtctcccactagattccccaccgaattttatatctaattctggatcaataagtaaatccattgacccaatcgacaatctttttaggttttttacgctgcggatttcattgtcaagggactgtgcagcaatcaaaacttcagacttccgtttatccctttgactagcgatcgccttatcgcttgatgtagtacgcagcatgctctcgttatctctattggacattataaaagacagctaaattctcctttgaattgaaaatatgtaacccacaaaacaaaccaaaactaactaagaccttaaattctaggagaccaaataaaaaccttaaaaaaagaaaaacgtcgaaacctattagatgccaccttctctctactcttagatctgacaacttcaatatcactgacacgaacgacttgttattgagtccgtaatacaaagtataggtgctttatagtcctccaaattctttcaccaaaacaccaaaactcgattttttcactcttccgtaacaaaagcccggtcgctcgatagaattccataatagtagtgaaaaaaggttatagtacataggaaattttaaacggtatacaagtacgtaaaaaaggctaaagggttattctataaccaggagttcctaccagagtttgtaaggtatccttcagggatattaatccaaggatcagcagtgcgaagtagcacttattccagattgagaccaatttggaaatgcgtccagctttcttgtctactactgtgaaatgtaaattcaatcttgaaggaccaggaaaccccatgatattgcaaagggcatgcagaattatgcagcaccataggttcccgcctgttcttacgaatacaaacttggttaaccctccaaaaagtgttgtgtataaaatttggaagcatgttgtcagcagaatggaaacagttgtcatggagccttcctgtaattgctcataagcatggtgtgcgtgcgcaagtccaaaaaaaagcgatggttgccaaaataactgttgatagcttagttgcgaatgcggtattaggtttaagtacgtagtcaaaagcattgacgtgtaaaatatttcctcagttattggtgcaaatataaaattcctgaaactccaaatactcaggaattcgtggtaaaaatcttcaagtatagagctctttggatttaataaatgatataatacaaaatctaaaacgggtccacaatataaggtcaataacatcgcaacacatttcgttaagtctttcacgaactggctgaattgccaagggtttggcaatgcagcgtaataacctgggataatacctaagccgaaaaatgcgtccttgaaacttatatgtgaagtggtactagataattgagattgtaaaaaaggcaccaaaaaaaggttggaaattagcataattgtaagtttttgcatgcgagatttaatcgttcgaggattatctcgtttagacccttctggttgtgaagttgcatatagcggtagcacataggatatggagatgtataggagcactagaaatgttgagaattgtagcattgctgttctggttctctctatgacagacagtcagtagtcaaagcatcaatttatttcgttttatttttcttgacaaagaaaattctatgttttgttcctgaaatctcgatattttagtaacttaaaataaaggtaataaaatcatcaaaggttttccatccagtggtccaaaaaaaaaaaaatacagaagcaacaaaagagcaccagaaaatgcattttaaaagaattttattaataatagggaatacaaaggacgcgataaataccttcatctatacgcaaaccatacatatatctatatctataagaaaagtaacgagaattttttctaatgtttttttattttgtcacttgcctaacagaaatagggatatcaatcttcgctacgccaagatggttttcaaatttaatcattactcgaacgcaataaaacctacaacataagcagctttcaaaacttggaattaaagtttccttaatgtccttattaaattccaagttcacattaatgtctcgtttgtactgtaaaggagcaatcctaacccatttatgaacaatctggtctgtaaacttcagggaagtagacgagctactgctaggtaaaaataaactactcttggatgaagaagttactggcgttaatggcgctgaactgggcgacgatgaattaccgttacctgtgtgcgatattgaatcctcagataatgcgtgctttgagtgttgttttagggtactgacctgttttttaaaaatgttggataagttgtgaacactaactttcaagttgcaaatgctttcgatatcgttaaacagctgtgaggtaataaaatctgtaaatttcagttcctttggcctacggtctcccctattcatattatataactcatttaattcaaggaaattcttgttgaacttggtttcatattcacaaatttttgaatggaaatcatcgtacaaagctttgatgcttgtcagcttttctttgttcatcaacagttcagaattgagttttattgggatagaattatcagatttagctgttatacatatcagttctgtggtaatcgattgaatttctggcggatcatgaggtaagctattatcggattctatgcaagtcaattgtaaatcaagtttttccaatggtttttttacgtcttccggaatcaactcagacaatctcacccaattttcttggtcatgtttactcttagattcaaaaacattggtctttctcaataatgagggagcccaatatggcaggccctgttttggaattttcgcctttactagtattagccctgtcctttctttatttcccgttaaatcatgattattctttcccgcattagaggaagaggacattgagctggaactgctgtttaaaaaatgagagaagttcagaaatgaagaggaattggatttgtttttcagtttatattttagttcactttcaacaaagggaccccaagctctggaagtatcggtattatgaccactatttccactgcggccattgtccaaattgtggcccaacttcaaatcgttatagttgactaaatagttatttctgttcttaatgtgcagttggtccaatttcctctgcaaaatttcttgggagtctgattcaatagaatcatcaatggtaccactcaagtctgcaccgtgaatgtcgcggttcgttatgggttcttttttctctaatctctgaaagatttttctaagagcatccaacctttcctgcactagtttggtgatatcattcagctgactcatagtggttctttctccgacgacattggcgtcaaaaccaaaagggattactcttagattatattctctttccttcataatatacagtttagaggccttttgatctttaccgacaatccttgcatcaatagtgtaattgatcgaaaggttgtcatcagacatatcgttagttaagatgggggagccctttgtacctaaatgaccgcacccaagtacactattgactttgataccggaatatttgcaattgttcctatatttatcaataccaaaactgggaggtgacaaacaatgagagaaatgctcctgcttacaagtgacatctagcaattgcagtggcaatttgaaaatgaagaatttcttgtacttgaccccgggttccagaacccggctattgtttagcccaaatacagaaccatcgtagtcaacatctgcaggaatgaagtccacaccggaccccagtgctattttcgagtatgaccaagaagcgctcaagtctaccatccttaaaaaccgtttaatcgttcttttactctttactttatcaataatggaaatgtaagactctaaagtgacatagaacatttcaaactttaggtttgcttgagatttgttttcaatcgtgataaaaccatgaatcaaatcccccgacgtatactctttcaaaatggactcctcctccggcttcacgtgtggtataggtgcatgcttcgtcgtcttgatggtgatttcgatgggtgtggacatttttggtaaagtgtacaatttgtcgatgaaaatgttgtctgtatcgttcaagtcatcaagtatgggaggtacatccagtgaatcttcatcgacagcggttgattgatgtgctgcaatactgtgatgttcggttcgaaggggaattaagttttctaaatttgatgttgacgaagaacgtgtggcacccaatgcgtcagtggacaatgattgatgtgagagatcagcgctcgagcccgcagcacctgttgcagtagaattattggcctcttggtatgaaggtgggaaatcatgcctatctggatcgacgttgccctgcggaatgtgcctatgcagagcattgtacatctcaaatgagggcagtacatcaacaacgttgttgatatctccgtcggtcaaggacctttcggtctcgacgggggtcgcatttgcagttgatcttctcaaaggagaacgattacctccagcaggcgttccggttgaaggagcatgcgaatgggaatgtgctagttcgggacgtcttagtccaagaatccccgtagcagacgcgcttcttatccatgattttggagagtgtaacgacggtgacctcgaactgcctttaccaccctcttgtttctgcctaccacgcccccttgtgtttgcattagcgttcatagttgtcgaactatttgcagtaaaatcagatcgttgaggacgcagcaaaggcttcctcttcggtggaaaccccgaatcgttcaaatctttggccatttagcgtacaatatacctgttgacacacacacgaacagtctcttttcgcccttgctaagagcttctttccataatcactatgcggctcttcattgcaatacttttatcattattaaaatagcctctgagagcgggtcacggcccgctgaagggaaagaacaatttaaagccagttttaacttcaatccaccgatggacgagaggcaaataagacggatcaaagacaccgaatcatactagcacgataatgtcgttgaatatacatatcaagtcaggacaagacaagtgggaagtaaatgtggcacctgaaagcacagtgttgcaattcaaggaggcgataaacaaagcgaacggtatcccggtggcaaatcagagattgatctactcgggcaagattttaaaggacgaccaaaccgtggagtcataccacattcaagatggtcacagcgtccatctggtcaagtcacaacccaaaccacaaaccggcagtgccgctgaggcaaataacgccaccgccaccggtgcagcagctggtactggcgccaccccgaacatgtcgtccggtcaaagtgcaggcttcaatccgctggccgacttgaccagtgccagatacgctggatatttgaatatgccatctgcagacatgtttggcccggacggtggtgcattaaacaacgactcgaataaccaagacgagctgttgaggatgatggaaaaccccatcttccaatcgcaaatgaacgagatgttgagtaaccctcagatgttggactttatgatccagtccaacccgcaattgcaggccatgggtcctcaagccaggcaaatgctacaaagtcccatgtttagacagatgctcaccaatcctgatatgattagacagagcatgcaattcgcaagaatgatggaccctaatgccggtatgggctctgcaggtggggctgcctctgccttccccgctcctggtggcgatgctccagaggaaggctccaacacgaacactacttcctcatccaacacagggaacaacgcagggactaatgcaggtaccaacgcaggcgctaacacagctgcaaacccatttgcgtctcttctgaaccctgcattaaacccctttgccaacgcgggaaacgctgcatccaccgggatgcccgccttcgatcctgcattgctagcgtctatgttccaaccccctgcacaagcatctcaagcagaagacaccagaccaccggaagaacgctatgaacatcaattaagacaactaaacgacatgggcttcttcgatttcgatagaaacgtcgcagccctcaggagaagcggtggctccgtccaaggcgctcttgattcactactgaacggcgatgtttaaataaacgtctagatgccgcaacctatatacttttaccctattctatcggcatatatttaatctacgtattacatgtatccatcaataatatcatcataatatctggacacttttggaagacgcgcccttgcgaaagaaaaaaaaaaattttcgtttcacacctacagtaataaacacataataacaacgagctaatcatcccaatcaatcaccccttccccctttaattagcagcaagggtactgtatttagtcatatagcggtacttgcattgaccgcgaacgtgtaaacataagcaaagcagattatgaccacacaaataaggtctccccaaggcttgccgtatccgattcagatcgataaactcattccaagcgtaggttcgtaccttcatgagggtgataggttgcttgtctataagttctggtatttggtggaaagggcctcagacactggtgacgatgataacgagcacgatgtttcccccggcggcagcgccggaagtaatggtgtctctccgccaaccaaacaactgcgtgaatccatagaattcttcgaaagtccctacgagggggacttgattagttggaatgtagacgtaggagatgaagtagccactgctaaccaagtgatttgcgaaataaaaaggccatgtaaccatgacatcgtgtatggcgggctatgtactcaatgcgggaaagaagtttctgcagatgccttcgatggtgtaccactagacgttgtcggggacgtggatttacagattagtgagacagaagccattagaacaggcaaggcattgaaagagcatttgcgacgggataagaaacttatcttagtggtggatttagatcaaaccatcatccattgtggcgtggaccctacgattgcagagtggaagaacgaccccaataatccgaattttgaaacattaagagacgtcaagagctttacgttggatgaggagttagtactcccacttatgtacatgaatgacgatggttctatgctgagaccgcctcccgtaagaaaatgttggtactacgtgaaggtaaggcccggtttaaaggaatttttcgctaaagtggcgcctctttttgaaatgcatatctacacaatggctacaagggcttatgccttgcaaattgccaaaatcgtggaccctacgggcgaattgtttggcgatagaattctgtcgcgtgatgaaaatgggtctctaacaactaaatcattagctaaacttttccccactgaccagtcaatggttgtagttattgacgacagaggtgatgtttggaattggtgtccaaacttgatcaaagttgttccttataacttcttcgttggtgtaggtgacattaattctaatttcttgcccaaacaatctacaggaatgctacaactagggaggaagacaaggcaaaagagccaagaatcccaggaactgctgacggatattatggataacgaaaaaaaactacaagaaaagatagataaagaagttaaacgccaagaagaaaaattgaaccatcaactggcgactgccgaggagcctcctgcgaacgaatccaaagaagagttgaccaagaaactagaatattcagcatctttagaagtccaacaacaaaatcgacccttggccaaactacaaaaacacctgcatgatcaaaaactactagttgatgacgatgatgaactatactacttaatgggtacgctatcaaacattcacaaaacttattatgatatgctctcacaacaaaatgagccagaaccaaatctgatggaaatcataccaagtttgaagcaaaaagtcttccaaaattgctattttgttttttcaggattaatacccctcgggaccgatattcaaaggtcggacatagtgatatggacgagtacatttggtgccacttccactccagatatagattacctgacgacacatttaatcaccaagaaccctagcacttataaagcgcgtctagcgaaaaagttcaacccacagattaaaattgttcacccagattggatatttgagtgtttggtaaattggaaaaaggtggatgaaaaaccctacacgttaatcgtggacagccccatctccgacgaggaattacaaaactttcaaacacaattacaaaaaagacaagaatatctggaggagacccaggaacaacagcatatgttgacatcacaagaaaatctaaatttattcgctgctggtacttcatggttaaacaatgacgacgatgaagatattccggacacagctagcgacgacgacgaagatgacgaccacgacgacgaaagtgatgacgaaaacaactcggaaggcattgacagaaagaggagcatcgaggacaatcatgatgatacatcgcaaaagaagaccaaggcggaaccttctcaagatggtcctgtacaacataaaggagaaggggatgacaacgaagacagcgattcgcagttggaggaagagttgatggatatgctggatgattagcagctcagattccgtatccttccacacattttcctcattggtctttgtacctataattgttcatattatatatacgtttgtaacaaatcgataaatagcaacaatatttttgcttattttgatatcctgaaattccttttttttttttttggtttcatttcgtttttttttttgtaacattatatattgtattgttttctcccctgtagcgagaactaattgattctttctcctttccccctaaatactcaacagtactctcgagccattagctgctgcaatttcaaaaaatgttgcaaggaattttagaaaccgtatcatctgacttgaaagatccgatatcattatggtttaagcaagaccgcaacccagaaactatagaagaggtcaccgctctctgcaaaaaatccgactggaatgagttacacaaaagatttgattctagaattcagtttggcactgctggtttaagatcgcaaatgcaagctggctttagcaggatgaatactttagtagtcatacaagcgtctcagggattggcaacttatgtaagacagcagtttccagacaatttggtagctgttgtgggacacgatcatagattccattctaaggagttcgctagagctactgctgctgcatttcttttaaaaggatttaaggtacattatttgaatcctgaccacgaatttgttcatacccctttagttccctttgcagtggataagctaaaggcctccgttggcgtaatgataacagcaagtcacaacccaaaaatggataatggatataaagtatactattccaatggatgccaaatcattccacctcacgatcatgccatctctgattccattgacgcaaatttagaaccatgggccaatgtgtgggatttcgacgatgttctaaataaggctctcaaacaagggaaattgatgtattccagagaagaaatgctgaagttatatttagaggaggtttctaaaaatctggtagaaatcaacccattaaagcttgaagtaaaagccaaaccttggttcgtttacactccaatgcatggggttggatttgacattttcagcaccatcgtaaaaaaaacactgtgcctggtagaaggtaaggattacctatgtgttcctgaacaacaaaatccagatccttctttcccaactgttggatttcctaaccctgaagaaaaaggtgctttagacattggtataaacttggctgaaaaacatgacattgacttacttgttgccaacgaccctgacgctgatagattctctgttgctgttaaagatatgcagtcaggcgaatggcgacaactaacaggtaacgaaatcggttttctttttgcattttatgaatatcagaaatataaaagtatggacaaagaatttcagcacgttcatccgttggctatgttaaattcaacagtgtcttcacaaatgataaaaaaaatggcagaaatagaagggttccattatgaggatacattaacaggatttaagtggatcggaaatcgtgccatactcttggaaaagaaaggctattacgttccttttggattcgaggaagcaataggctacatgtttccagcaatggagcatgataaggatggtatcagtgcatccattgtcttcttgcaagcctactgtaagtggaaaatagaccacaatttggacccgctaaatgtcttagaaaatggcttcaaaaaatatggcgtgttcaaagagtacaatggctattatgtcgttccaaatccaactgttacaaaagatatatttgactacatcaggaatgtctacactcctgagggcgcgtcatatccttcatctattggtgaagaaatcgaagtactttactatcgagatttaaccactggttaccaatcggataccataaatcataaacctactctacccgtcgatcctacatcacaaatgataacagtatctgctagaccaagtaacggtagtgagaatgagcatatccgcttcactattcgcgggtccggaacagaaccaaaacttaaagtatatattgaagcttgtgcaaatgaagaacaaagagcctctttcttggcgaaattgacttggaatgtgctgagacgtgagtggtttaggccagatgaaatgaatatagttacaaaattttgatactatttcaacctatacattaagaccaagcgacttaaagaatgccattatatttgttgtttgtacctacacttatatcaatatacatttaactagtttatgcctccaaacttctatcttcagattttctgtgtcgattccaaaggttttcaagcatgtaagtaacactaatcacaacaccgagagaagcgagtccaactcccagatatacagctgctcggtaacctttcaacaaatcattgccgcttttattgatttggtgttcaacagtgcctcccatacctaaacatagagacgctgaataattaataacggtgtttactaatgatccagccataccttgatactgcattggaagcccgtcactcaatataatggatgatgccgggaaggacaggtccataccaaaacataagatagcctgcatcgcaaagttcaacttccaatagctttgttccactggcaatacactaaacattatggaaccagcgtcaaatgccattagtgaaaaacatagtagtagagctggtcctaatctcttgatagaaaaggcaacgaagaatgcagccatggatccgaaaattacgaaaacgaaatacgtacctccggtccaaacaggactgtaatgcctcaagtttagttggaaggaaacataatagaatgtccaaataccaaacgacccccatcccaggaataccgccaataatatcataatcatatgacggttcttcgtcattgcacgtggtagaagaggaacctctgcgtatttactttcataaacaaaaaaagcaaccaagaatatcacagatattatcaaaagaacaatgatataaggtttgtcccagccaactattggtgcttgattccagacaaagttgaaaagaatcagcccgataatggcaagcgcggagccagtccagtccatcgaaagcccatgaatatttgtgggaacgttgtttgggatggagtaccacgccattaataaacttagaaacgttgcaataccaaaggcataaaatacccaaggccactgattggggtcttcagtgacaattaaccccccgaataatccaccaaacatgccgcctgttggagcacatgcaccgatgaaactaataacaatgttcttcctgaatgaaccgaccttataaacatgaccgacaagccccataatatttggtaaaataaacgcaattccaactccttggaacgcacggctcgtaatgaaaaacgcgtcgctattagagtatttggagagaccagaaattatagaccaaacgattacgatgacataaccaacgatcaacattttcttcaatccataaatatctcctaacctcccactaataaggatgaacgacccagcagccaagggaaaagatgccatcaaccatgcctgattgtttgcttctgaattaaaggatttcgaaagaacgttcattatacagagagcgtgtgtttggcccgcttgattcaataactgtgccaacatgcatgtcgctatgaacattaattctttcccaaaggaactgaagtaagtggggtcctgccatggtgagtcattggtcacttgagttgatttagttgaagaaacaattgttgtcacctcttcatcttctgtggaaaccactactttatcttttgctttcactgtaattttctcatctatctcagagtctgtgccctgcacgctcgttttctttttgaagattgaaaacatttccaatcagatctttgagttgtatgtttggtgtgcttagttgggtttccagaactagccatggttaaaagatctatttccattgccttatatacctatttttgtccaagccaaatgtctctgagtatttcctcgaaaaactgatataaaagaaaatttagttcgtaaccatggcaatactgtagcataatcttcgtcatgccattgttatctcataaataaaactcctataacaaagcaaagaaagtttacgcgttctacggacatttgtgtaggaaaaataaagattctacttaatcaatatacgagccacgtttttggcgtcgcattgtcggcgctatttatgcgcacccttgttgccttctcttcccttccgtgcagcctccgcgctgtcagatggtcctccggtaacgtaaccatgggaactagcaaaaaaatttcctaatctgaaatgtagttccattaagaaatctgaggaacatgggcgctgcatcaagatgtgttttggcgtcgtctttgttatcttttcttttttccaacaataaatttggctgttcataaggtgaacggaagctacggcaattgccctattaagaaattatacgtaagaatgttatttgtttcatgaatatttagaggattccgttttgaatatattacactatgaaataaagaattatttggcgttttgccattggaataaatcagatacattatctgtgttggaacttccgccaccggaactttttgatcgatctgtattgtaacgatttttctgaggccgtcttggaccacggtgggacgccgagggccctgaagaggtccttctcatttgaaacagtgtagaaggtgtatccaactggttgccagttgcactctttgagttctcttgagaactactgtcaccttttgaatcattacccgatgaaagagatctttgattgctggtatttctcgtacttacggaggataccattccttgacttaaaattgagtcggtagggttcaatacttctctggcattcatgcgcgaccgatccaagtcatcgttaaatgtcgtatctaggatgatgctgtttttacttcgatttgacgtagtagacgtcgtgttggtatttgagatatcgggcgtatccactaataaaggagccaacccaagtgatgcgtctacaatgtaatcatagtcgaccccagaataattgacatttgtcatgaaattgttaaaattacctaaatcgttgaaatcacagttgtccattccatgctttgtacttccaaggatactgccttggctggtattactgccagttgaaggtggtttgaagttggcacctgcatttgtaacggcttttttatttgttcccggatccgctgacgcggagttctgatcattttgatataaaaagttgttaatactaatattcgagaaagaattatcgttgttcagcaatctcattagctttgttaggctgtagttactcttgttgttgaaagcaagattattcttttccatattcgtactttttcctttctgatgaaattggttattttttgaattctcagggttttgcttaataacgggttctaattgttccggtttagagtccatattgtccttcaatagatctaaattacttggtaggctgaatatcgcatccatgtgcataggcttattctcaaccgtgttttgacctatattggagctaccggtctgtaagaatggtgccatatttaaaaagcttaaattctctatattggaatccgcggcatctgtagaagctctgttgcacacatccatgttgccattattagtattcgtacaattcggtccttcaggatgggtgaacagcgcagtaaggtctgtattactaaacgagaatggaaacagattgctggtggacatgttttttttggtatcattcgggaaattctgtgcgttttcccccttggatatactgccatcttttgcatttttttcatactttaatctcttattaccattagttgtatttgtcattggcgagtgacccgcttcagaattattgttattattactatcgtttccataaagatactcgtgttctgggttttctcttttgacattaggtgttctttgtctattttccaggctgttcttcgattgagagccaaatagtggttttaaggatgtggttgtggccggtggtaaccccatcaatctattgtagtaattcaatttcttttccaagaatttatccagtctttcaaccttaacattaggtgctttcaacaacaggttgatgctcatgtcaaacagtttcagcgtgtgccaagaggcaattccaggtaaatccaaaagcctatcgttttcgatatctttgatggtgtcgaggagaagatttttattatctaagaataacgcaccacctttggtatattccaaagaacctctagcacagagcaaagaaaatctgattaacgttcttgatacattcaatggcaaaggtaaatacatggaattaatggcctggaaaatcgtaagcgttgcattggtagcttgttgtaaaatgatatatgaggatgacgtccttatagcaggagaagtcatatcaacatctaatatcatgtggtcctggttggttgcgcctttagagtcgttgttgaacattgactgtttcttctttgcggcattatctacattcttaggcaaaggtttggttgcaataaccggtaaatgtatcatagatttggccaagaaataaaacagtaatagaatcttcttttcaaataatattatgtctttcttatcaaatttggtctcagtatttctttgattggttgctctaatctcgtctaaattcacagttccgtttacagttatttgaaagtagtacatttcgggaagttgatttctccagttatccagtgcgttttcatgtactaatgcaacttcagaagttatacgttcatccatcattcctctcttaaaaatcgagtctagaatgttacctaatattttcgcaaatctgattatctgcaatgaaaagcttgaaacttgaccttgcagttgaatctttttagcttttttatctgctttttcattttccatagataactgatccttatactcaacatcagaaattggtaatgcacattcaatatcaaaatccttaagtaaacgaggaacaccaagttgcaatgaggcaaaaacgtcaacgtaataaattgcccaaaacagtaatctcctctcgctttgctcaaatttttgtagaactgggttagagtgtacacttaatacggcactaggacatctgtgaagtctcaattgttgtgccatagaaacaatacggcctcttaccccatagattgccgaaatatcacccacgtttaaataataaaaggatgccaaagataacaattgtaaggatggtaatgaagttgtggacatatttaaaaaataaggatttttaggaattattagggaaagctgatgataatatgccatcaatctagcatatttggccttcggattcttcggtacagtgtattttattttttccattttaatcttaacgagtaaccccatttgtaacatcatcagaagctttagggcaaatatttcatgattagtggtgactgtacttttagtagtgttattcgtctccaaattttctgtagataaatgcttcacgacttcaacaaaattgttgaaatatattaagaagtggtcattgtttagaattggtacctgattagaccaaaatttgaaaaaaaggtgtaaaagctctttaatttcagtgagggaaagtagttcatcatcctgatcattagccggcttttctgattgctttgaaaacgagttaatgttaaatttcaaagaaattaaaaactttttcaaatcgacaaactcggagaggtttgtgctttgaaaccttttcacaaaagccgaatcatcatcaagttttttatcttcatctttctcctttaacttggttgatgttgaaggtgctagaagccgtggtgctggcaatctatttttcaatgaagataataatgaaaccgtatacaaacattgctttgagttgaaaccaaatatttgtcttatcctagttaaaagctgaggaataaacagaatttcttcagtagatcttgggatggataaagaaactaaagttgccaattgagtgctacgttgatgagtcgtcattgattttaatgcctttaccgcaggaagaccaggtgcctcgtcctgttcaaaagatatagcggttggatcgtttaaactcgtagaagtaggcttgacgtgtaaatgatttgtacaggaaacgccgtcacaaagatggtctttgtgtggcggtggaggtggtgcccccaatggactcattgcagaaccgctattatcaccatccattttgccattttgtagctgcttattaaccgtttgatttaataaatagatatttgtagaagacagattcaatggagcatctttcaaatcatgtttgaaattgccatttatggtattatccgttgatgtctgtggtcgcgactgtgaaacaaggcttatttgctgttctttgatatcacacaaagctagcaaacgcttattctctgcctccagttcgcgtactctttcttccaggctttctgtgtacccttttggatacgctttcctcagtaatttatcgcttattctgcattcaaatccgacagcagcacactgcgaacactgtggtctttttccatcgcaccttgttttcttagatcgacacctgtcacaagcttgagctatcctgtaaataggtgtagataaaggagtcggagaagctgtcttgatcattgcttccttcacgttcttggaaaaatgagggtttgcctccgaacttgaagttctattagatatgctaggaccgctaagcgcttgtgaacccagagttctaatgactctgggttccaaaccttgtcgatcagaattattatttgccataattttgtgtcttgtcttttactcaacttgtaaattctctttagggtgttgtaactgtttatgaagaaataaataccgtaatgaattattaaattattaaattcttcgtctttttacaatatcacaggtttaaaggggagtttaacaaaatctactattttacggctgttttctttttttgagtgtcactgaccaatcatgctttcgtaccccacaaaatatcagccccgccgctccatgcatgtctcggttatcgcttaatacgaatataatcactgagaacctcggcggcaaaaatatttaccaataggcaaattaaacaccgaaaaaaagaagtttcaagtagaagattatcccgaataccaaaaaattgcacgagaaagaatgtctttttatgatttattgcttataatactcaattactctggttttctccgttcctgttacgcacataaactctctctgtctctgatatcacaactcatatcgcgaataaacaccggatagaaagaagtgagaggagctacgataactgaatatactctttcatcaaaagtaatgtgctaataaaaagaaatgttgcaccatcttaacagatgtaaaaatgttctgcagaaggaaagttgtgtaatcatacacattcaatagtataagtcgtatcacaatctgatgataaaagttgttacctcttttaactgcctctgatccttttcacattcagtaatttctcgtagatgtatatgtgcgaatgtgtcaatgtgtttgtatgaaataaactagtagccgggtaacaagtactcctaaattcccgcttcgccgtttctatctcattggagtcgtcccttctagaaggtttactagttacgttaacgtcatagaaaaaggaaaatcgacgctgcgcttttatttataatcttgcattgccctccttatttatcgaattgttaagtgtagataggtgacgctagagccgtatattagattctttcaaaccctgaagaaaagttaaatgaagatgttgaggcgtacaaaggtaaatttttcaaaattgctttacaagattactaaactagcaatagtactgacgatcctatatatttattttacgcccaaaatcgtctcccgaaacaatgcatcattgcagcatatttttcctcataaatatggcgattatgaaatcaatttggtcatagcgcaccctgacgacgaagttatgtttttttcccccataatttctcaactgaattcgtactttccgagaaccgtcccatttaacataatctgcttatcaaagggcaacgccgaaggtcttggcgaaaccagggtaagagaattaaatgagtcggccgctttattgctacacaatgaaagagcagtctccgtacaggtgatggatttccaggatggtatggacgaaatatgggatattgattctataacttcttctctttcacaaaagatagatataaagaatcataacttgaaccagattatcgttacctttgattcatatggtgtatcaaatcatatcaaccacaaaagctgttatgctgccgttaaaaagttggtggatgattatgctcaacctaagaccaaaagaaatgaacaaccacctcatgtcactgcgctttatttgagaagctacaagaacaacatcgttttaaagtacaactcctttatttgggaaatcctaaaaatactttacgacctgatttctccattccgtagaataattcaggcgcttccgcctaacacagccgccgaaaaagacaagctttcacttatgaatacacatgcacaatacgtactagcgtttgccactatgctaaatgctcacgaatcccaagttgtgtggtttagatacggatggtggatattttccagatttgtcttcgttaatgaatttgatgtttatacatattagactctacactgtagatatatatataaaaaagtcccatattatttacatcctatagaataagaatatggagaaaaataaatgctaattctacttacacttttcttaccaaaggctacctataatcataccatcatcttcatcgtcatcgaaactatctagccgcactttctccctttcctttttgttctcaatcttgtttttcattttcttacttcttagaaacatacgattcgcacaaaaaatattcaaatctttggtcatttttctatcaaaaccataactatcaatgaattcccttaccgctgaaaatctacctctatttacaagctccttaataatacatttttggtatttgataatgatattgttaacttttccagcattttctgctctcgttctttcgatccccggtttgaaactccttaaaacatcaattccaagcgggaaattgcctgttttcttcatgatatcgtacagttgtctcaacgtctcataatcaactgaaggccttagccgcttagatgcataccactgcttcattaaatgccaacatctaacaacagaagtggctttcttgtcgtttgctggtgtccaagcaaaatgacttagctgaaacagccttctccaaaatagcgcatccaatttcacgtccggatagtgctttatgaatgaatccaaaatacttaggcctctgtgaagatcgtggtcattaaagtagaatgacactaagattgaaacgagtattttggaactaggatagcaccctcggtgcttaattactacgtgactaggaaactcttggggtgatatttgccatatatgttcaatacaccgttccaatatttgggtttggcctaggtgtccaaaggattgaattaaagtggacaacaaatcctcggaattcaaaagctttttctcctgcagagcaagatcagcaatctttaataatgtttggtgatccatggctttgtaagtagaagaaagacgaattgacgtatttttcgcacctagtcgaaccatttttcttaaaaaaccttgtttttgctcactattatctggtattttccaataaggcgccaaagcgccacaacgcagttgtaaaaagtgaactattgtgctaatatctgcatttttcggagacagtaatatatcaggatttctatcaagaataaagcttaaaattttttgagccttacctaattgaccgagctctataaagttcttgatcataagatttgcatcaaatatttcacatgcatctagtttcgtattccgtaagttaacttggtttctcttggcatcaactttttctgcatataaggaaaaaagtttgaaccaaaattctgaatatttagcgtttatgtctctacagattctcctaatttgaaaccgttgtgtgtatagtttgctcaaaagaaaagacaggtcctctaaagacagaacatccttcggttcagggtccacggttttcgcgaataagtaacttatactcttggaaaattcggattcatccattccactcgagctgataattcgttttaatgtgtgaacatctataggtataccttttgcctcgaatttgtcataagcgctcccattattttcatcttttgatcgatcaattgcacataccgtgtgagttgaataggattttttgattaaaatatcatttatgacagccctacccattacatacgttcttcggggatagacagaatgacatattgtgctattcggcagtacaccaaattcacgcagcgatttcactgatacagtgcagagcctcttcgtgtaaaacctcagaacactgtaggatggatgtttaaccagtctatttatccacattaatcataaatttaggtagtggactgttaacgaaggagagcttcgttaatttgttcttgattttacatattcttttcattagccaatgtctgaagggctctttttcaatgaaccttttctgttcaggataaacggtaacccgctctttttctaataaaaactgacgttatttgatattaaaatatacagtgacattgcgagtaaacatctcagtattgcctaactcactacattaaaaagctattgacgctgttcagtgttgctcttgaagggttaacgttgcgtcctttcaagtgggaaatcaattttgtcaagtgttttcttacaataagcttactgatgtccggtaactccgacgtaagcatccattcttcagtatatttggtacaaaggatacttaagatgacaccgattgacatatcagtacctgtattgcagcatattagcattggctttattttttcatctcgatttgtaaacaacgattgaatttctccatggattctagggaatgtggatcgtaaagcttttgaacttttcttgtctccgctttgcaacttgtatattgaaataaacggatctgtcccactttcttcttcatcgtctgtatcttcagcaacagtcaccgaattactgaaaattataactttaccatattctgacttcaatttctgtttcaaattcttattgatggttaagcctgaactcacttttcctagagatatctcattcgtaattttatcaatgtttccaaagacttcatccaagcttcctttatcttgtatataacactgatttctcagctttgcagcagccaaatccatgatgtaatcatgtaactggtcgtctgaataacttgcgtcgcctaggtattctatatgggcccaaaacatatttgaatccaaaccaaaagaccagagctcgtgatcgtcggctgcaccctgcacataagtgaagccgtatcttttatccataccatcttgtgcttgatagcttaccgtgcacaaaataatgggtattatgttttggtcttcaggtgtttcccaggcttcatactcctgtacttcacccgtgaagtaatcaacagaatggtctagaagtgaagaaccagggtgaacccatatgggccgcaataacttacccataaacagttcgttcaatttcttagaatctataatattcaatttttgtagtttagcaactagttcgggtatttttcgcttaatcatgtcatattctgatttgggaactgtctcaggtggaagatacagtaccttatcgatggcaacatttttttctgtttcctgaagcattaacgtatttaatacagcacaccatatggggacagtcttactcaaagcatctgggatttttttacctcttctagtactatcgacaattataatacctttattatctcgaatggtctctaacaaatgaaagttcaatcttcgggtgctaaagtcccattggttgacatgcccgtctgtgctcttaaagtaactggtctgtttgaaacttgatggattacagtaccatagcccacatctttcattgggtatcagtggataatggggaaatatagggataactcgatcttgcaaaaatttattgtctaaaagaatactctgaagtcgattccttacggacttgttttcctttctgatgtctttatttatctgagatagcgaaagataaatattttcatccatcacggatatactaaactgtactctggatctatatctctttgatagcctcgataccatccatcaagagatcaaaattttcaagcatgctttttttttcctgcatatgaacaatgaataatgggcccagtcacagttaagcagtaataagaacaaagcacataaacatacaacgcatatatgaagagcaatagagtggtgggatgattttagaagttcatttttgatgaagatgataagattatgtaatagcggctatgctaagctcccttcgggcatggaaatcaacaaaaaagttgtaaccgtacataatatgacgggaaatgcaacaagctttccaagaagtaatggaaggcatagctaaaggactatctggctcggccataagtttgaaatttgtgtatacaggtataggaaacccttatacctacctaaatcgtcgaagctactgatatattgcgtatagtcgatatgcccaatgtaattcatatttcatactcttctcttgtacagattaagggcacctgttttattcttagaatatactacaacctgcctactaattaacaatgatactattaacggtgcaaaaccggatgctcaaatttaaagtgattactcagttataaacacgcctggtgtgaaattaacgaccattaataagaataaatattactggcatattataatatgcggtggaaaaacataaaataaggattgagaaatagttatcaagtataatggaagctgaagtgcaaggattgataatgtaataggataatgaaacatataaacggaatgaggaataatcgtaattttattatgtagaaatatagattccattttgagatttctatcctcgaggagaacttctaatatattctgtgtacataatattatatagccttgatcaacaatgcaatcccaacaattatcaaattattcacccaatattcagtataatccatatttatagaatatataggataattatcatcccctcaatcaagttgatattccgttttgacaacaggtcacttctgcaaggttgcttatattaaaattgtgaataagcatgatattagacggactcataattgaatggttatcagttaattgactctcggtagccaagttggtttaaggcgcaagactgtaatttaccactacgaaatcttgagatcgggcgttcgactcgcccccgggagatatttttttacttttgattaccttaatttttgaagattctcaatttcatgtattagggattgctttaaggtagctaccaaatgacattctctgtattactgttctagttttcaacagtaaagctatgatttgttaagtgactctaagcctgattttaaaacgggaatattatgcgctcagtcactaatgcatttggcaatagtggagaacttaacgatcaagtggatgaaacaggttataggaagtttgatatccatgaaggaattttgttttgcattgaactatcagagacaatgtttaaagagtcctctgatctagagtataaatcaccattgttggaaattctggaatcactagatgagctaatgtcacaattggtcataacaagacctgggacagctattggttgctatttttattactgtaacagagaggatgccaaggaaggtatctatgaactttttccattaagggatataaatgctacatttatgaagaaattgaacgatcttttagaagatttatcatcggggagaataagcctatacgactattttatgtttcaacaaactgggagtgaaaagcaagtgcgcttatctgtattattcacattcatgcttgacacttttttggaagagattccgggtcaaaagcaattaagcaacaagagagtgttcttattcactgacattgataaaccacaagaggcgcaagatatcgatgaacgggcaagattgagaaggcttacaattgatttatttgataacaaagtgaattttgcaactttttttattggctatgccgataaaccatttgacaacgagttttattcggacatactgcagttgggttcacatacaaatgagaatactggtttggattctgaatttgatggtccaagtacaaagcctatagatgctaaatacatcaagtccagaatcctaaggaaaaaggaggtaaagaggataatgtttcaatgtccattaatcttggatgagaaaacaaattttatagtcggagtcaagggttacactatgtatacccatgaaaaagctggagtcaggtataaacttgtttatgagcatgaagatatcagacaagaagcatattcaaaaagaaaatttttaaatcctataacaggagaagacgttactggtaaaactgtcaaggtttatccttatggtgacctcgatatcaatctatcagatagtcaagatcagatagtaatggaggcttatactcaaaaagatgcgtttttgaagattattgggttccgttcatcgagcaaatcgatacactatttcaataacatagacaaaagttcgtttatcgtaccagatgaagcaaaatatgaaggttcgataagaaccttggcttctttattaaaaattttgagaaaaaaagataaaattgcaatattatgggggaagcttaaatcaaattcacatccttcactatatacgttatcaccctcaagcgtgaaggactacaacgaaggattttatctctacagggttccattcctagacgaaattcgaaaatttcctagtttactatcctatgatgatggctctgaacataaactagattatgataacatgaaaaaagtaactcaaagtataatgggatactttaacttgagggatggatataacccatccgatttcaaaaacccactattacaaaaacattacaaagttttacatgattacctgttgcaaattgaaaccacttttgacgaaaatgagacacctaatactaaaaaagacagaatgatgcgtgaggacgattctttaaggaaactatattatatacgaaataaaattttagaatctgagaagtcagaagatccaatcatccaaaggctaaataaatatgttaaaatctggaatatgttctacaaaaaatttaacgatgataacatttcgataaaagaagaaaagaagccctttgataaaaagccgaaattcaatatataaagacgattgaaatccttcatatctataacgttacatacaatatttggtagggtagggtatttgatgtaatatttattattaagaacttttgtcgtgctaaacgttgtactgtacaactattagcaagatatttatgcacgacagtaatctatagttgtaactctaaatcacacaccatagacaaatgatcacttgcatattctccaacatgtggttgtccatgctttgtcatttcattaccgggcggcattctcaaaaaacctctgcatttaactttattttctttttcaaaatcgccaagggtttccacttcctgacaattactttgtgggtcccatttctttacataaaatagatagtctaataaaccacgccaagtgtttgcccaatttgaaatttcaggctcacctctatcattatcaagacctgcattttctggatgaacattcttatacccaacagagtatagtgaaatagccctcatatccaatgagttatggagttgtgccattttatctacgagttcagactgttcttcattagcatgaaatttttcaggaacggggctctcaggttgatctttaccatatttttcaatattcccgccttcttcgtcatctgcaccttcttcgccatcacggaccttggaaaacttatatgaagtgctgcacccaatgacggtctttgccctgtttctatagtgcactggtttggatgtcatagataaatatggtgtgtcgaacggctgggaattaaaatcaccacagaaaaaaggaaaccaatgagataaatccccatcattttcgttctgtaaaacattcacacgatgcatgaattccttcatcttttttaaaacaatatagcattgtcttgttcgttcataagtaccaaatggatgccaaaatagatgcgtagtgccgatcaagataccgcattttttagacgattttttacccaaattcgacagtactttctcagaaaacttcaaggctaagactaatcccacgttgtttgtcgttgttctagtggaaatgctttctgaactttctttatcatagtcgattagcattttgtcaacctggtgaaataattctctcctccacattatcgcgacaccatggttttttgtagcatttctataatattgtccatcgtatcccaatttactgaattcatctttccaaaagctttgaaactgaatatgatcaatctcttgcaaacaaatgacatcggaattataatatttaaactcgtttaagagaactttagaacgcctgtaccattttaaagcgtcaccactatccgggaacagctttctgcggattagagcttgcgccaagcaattataagtcattagcttgaatctaaatccagttactggctctgcctcatgtagagataggaaaggtcttctgataaaatgcagctctggcgggcagtccggatcaacaccttgagccaacattgcatctcttttagcctttctcataacttccctttcggcacgaaccttagcgatatgttctggggtcactatgggcttcgattttttacctttcttgcccttctttttatgttgaagtaacgaatcatcattggtttgatgttttgcatcttttacagatttattaatttctacttcttggtcgggcgcaacatctggggcaaccactttgacttctttgtcttgtgtcatatttacttaatactcttaactacaattaagaagctataaggagactacaatctcatcttcttgcaacactacttttcctttcctcttgctttagtgcaaccattttttgaaaaatgaatggtctttctgcacgaaatatctctcgaagagcttttctagatattaaggataaagtatatcatcccaaaagttaggtgatggaatcaatattgatggaccagctaaaacacgttgaaagcagatatcaggaatggtgttttacaaagtcacgttgagtaggtcgcttatcggtgtgccacacacaacgaagagcattgtcaaaagtttgggtttaggtaaaagagggtccatagtctacaaaaaagtaaacccggccatagctggctccctagctaaagtaaaagagttagtcaaagtagaagtaacagaacatgaattaacaccatcgcagcaacgagagttgagaaagtcaaaccctgggtttatagtggagaagagaaccatcgactgaaacagcgaaaataaggcaactggatttcctttcttcttgatattcctgacttatatatgtatatagtattattttttcctgcataggcacatatgttaatagtaatttatgcaatttttgatacaaagaaatcaatacactatctcgatttcatattttatgtatgtatatatttacaagaagaaaattatgcatggtctattgaattttatatttggaaaaagagtccctttttatagcttttccaactctaacattccttctaaacagtcaatttttgaaattttacaattcttcacgatatctccaatcatcggataatgcatagaacttggatgcaattttaatgttcctctagcgaacgataagtctggaaaaacacatccagtaaatccgttctgcggtactgatgttaccattacatcgaaagtcctttctggctctagtttggttagcttttttaaataattcagtgtccagtacgtcgacgaattacggctagccctttttaaaatatccgctcgagattgaattggccagatcaaactgtcgatttgtgtttgattaaaacatagaggctttttctgcaaatgacggtgaatttgtagatgatttatcaagtctggaaaacgacgaagaggggatgttactgtcaaatattgtttagctccaatcatttcatgtctaaaaggtcgacctgtataaaaactcgagttcaacaatgaagaaagcttaacgatatcttttagcttgggaaaaattcctttttttgtacttgttatcatagaatcatactgttgttgtgctacttcgcccagtggtaactgtttataacatctgaacacaccaccgattttgttctccgcaaaatatctacccgttaaagtattcgccaagatcatcatttctgaaaccaaaatggtagacagcgtctcctcttgatccgaaaatgttacctcagtcagttctccttctgaatcggcgtttagcatcactaggcccttattaaagccctccccgaaaataacagcattactgttttttatacgttgttctctcaataatttggaaatcatggacaaactttccaaatcctttttgacaggtgatgcttcgctattgggtgtaccgagtatcctgtcaacatcttcataagtggcctttgggaagttggacacaatgcctttccggattttaaaactgtcatacataatttcaattgattttccactgcatttagaagtgattttaacatcaacagagaaggatatagttttcgtcctttgtccttgtttccccaaatctgataagtgacaaatagattgaggtaacataggaacaaccgtatctggtaaatatgtggtaaatgatcttttcaaggcaacatttaggatatctgtacttataccctcaatatcaacattagtgctttccggaaacatagaagttggatccgcaatatgaatatataaagtgtacagtccatctctaccatagtttttcaccgacacgccgtcatcaatctcatgcgcagtttcagagtctatacaaaaaaccctaagatcgccaaaatcgtacctatcgtcatcagtgccggattttttccattgcaattcttctatattagttaagtcgtagagtttttgttgccatttcactaacttcgaggaagcaggtaatgctaaatccatgttaagtaacaatggattgggtattgagttgggtgttatctcattgattaaatcttgacatatatctcttgtgatgtcacaatccttatagcgttctatctttctgaatatttttgagatcaaagctactataattccgttattgtgaaaattcccagcagcaaaatctttcaataattggatcacagaaggatataaagctgatatatcgcgatatttcctttcattcaccaattttacaaacttattgacctctctataactgttggcttctagcttctctatcacctgcgcataatataaatgttgtgattttaagggaataatcgttactgatataggcgacagcaacgctgtattcagatggatttccccccaaaggttcgattcctgttgttgcataatcgcccagtacgtggaaacaaaggtaggtgaatttattggtatatcgtttacagtgtgatagttattaactaaactagttaagtaatttattccatttttatcgtccaaggctttatttaaatccaatttctgaactaatccgactagggtaaaaaaaggaatctgccatggacccatataattttgtaatgatctgtggagtaactgtaattttttggtagtaatgggcaaatctttccaggccaactttgaaatttgggctggatacctacttgttattagctgccttgctacaataggcaaaatattcgtttggttagaaaagttcttaacggttccaattggcaaatgtttgtgatggctctcaggctgtataagtgaatggattccagcaggtaatttgtgaggaatcctcaataacacccggtttttggtcgcaaagcacatagttccatcaatagtaacaaaagtgtatcgaggatccatagtgctacttggaagacttacacacatcgccaattcattgggtctcatttttaaaagaacaaagtcaccaacatttaagggactttccattagctgaacaggttgaaattccattgggtttggagctttcagttttgttattaattgaaaatctgaatttattaacttgtaaagcggaatttttggttttgttaaagacctccaggagtttacgtaccaatcttcggaaggtttaacatacctatctttataacgttggttaaattcctgtttaatttgaggcagttgttttaattcaatatcaggctctaatccttttgttcgttgcagaaagtctttgtttattgattctatatctttctccggtccaaccgaacggtctacaactgtctctgtagcttgatcattatctagctctcgtgtgtgatctagttctacttttgcttgctgcttactcttacttcgctgtcgtttgcctctggtagttactctgaagcaaggtgtgtaggaatgaaagctccttgcaattagaagaacatgtactttccgcctaactaccatcacctgtctttatttattccgctgacagatatgcacaaccaattatcgtctcttgaaagctttttagacgtgattgctgttatttggcacgttgttagtatttaagcttattcgggtttgcattgatatttgcccgagcagaaatctccttctcgatgagttagaactgaaacatctcttcaattacttatacataataaacatagaaagccaggacctgtcatcatgagtcatccgattcaatttgtaaacgctaataatagcgataagagccaccaattaggcggtcaatattctattcctcaggatttgagggaaaacctgcagaaagaagctgcacgtattggtgagaacgaaaaagatgtgctacaggaaaaaatggaaactaggacagtgcaaaatcgagaggattcataccacaaaagaaggtttgatatgaagtttgagccggattccgatacacaaactgttacgtcttcagaaaatacccaagacgctgtcgtgccaaggaaaagaaaatctcgttgggatgtaaaagggtacgagccacctgatgaatcttcaacagcggtcaaagaaaactctgatagtgctttggttaatgtagaaggaatccatgatttgatgttttttaaaccttctgaccataaatatttcgccgacgttatatccaaaaaacccatagatgagttaaataaggatgaaaagaaagaaagaaccctgtcgatgttacttctgaaaataaaaaatggcaatacagcgagtaggaggacttctatgcggattttaaccgataaagctgttacatttggtccagaaatgatatttaaccgcttattgcccatattactagacagaagtttggaagaccaggaaagacatctaatgatcaagaccatagatcgcgtcctttaccagctaggagatttaacaaaaccttacgttcacaaaatacttgtagtagctgccccattgctaatagatgaagatccaatggttcgttcaacaggccaggagataatcaccaatctgtctacagtcgctggcctaaaaaccattctaacagtaatgagacctgatattgagaatgaggatgagtatgttagaaatgtaacttcaagagcggcggctgtggtggcaaaagcccttggtgttaatcaattgcttcctttcatcaatgcagcatgccactcacggaagtcttggaaagcaaggcatactggcataaaaattgtgcagcaaataggtatacttttgggaataggtgtcttgaatcatcttactgggctgatgagttgtatcaaagactgcctaatggatgatcacgttccggtgcgaattgttacagcacatactttatcaacactagcagaaaattcttatccatatggtatcgaagttttcaacgttgtactggagccattatggaagggtataagaagtcatcgtggtaaagtgctatcttcttttttaaaagctgttggatctatgatcccattgatggacccagagtatgccggttattataccacagaagcaatgagaataattagacgtgaattcgactctcccgatgatgaaatgaaaaagaccattcttttagtattacaaaaatgtagcgctgtagaatccataacgccaaaatttctgagagaagaaatcgcgccagaattctttcaaaaattttgggtcagacgagtggcattggatagaccattaaacaaagttgttacatatactactgttacattagcaaagaaattaggttgttcttataccattgataaattattaacaccattgagagatgaagctgagccgttcagaacaatggctgtccatgctgttactagaacagtaaacttattagggacagcagatttagatgagagattagaaacgaggcttattgatgcgctcttgatagcatttcaagaacaaacaaatagtgattctataatctttaaagggtttggggcagtgacggtgtcacttgacatccgtatgaaaccgtttttagcacccattgtgagtacgattttaaatcatttaaagcataaaactcccttggttcgtcaacatgcagcagatctatgtgccatactaataccagtcatcaagaactgtcacgaattcgaaatgttgaataaattgaacattatattgtatgaatccttaggcgaagtatatccagaggtattaggttctataatcaacgctatgtactgtattactagcgtaatggatttggataaactacaacctcctattaatcaaattttaccaaccttaactccaattttaagaaacaagcatagaaaagtcgaagtaaacactatcaaatttgttggacttattggtaaattagcacctacctatgcacctcctaaagaatggatgagaatatgttttgaactattagaacttttgaaaagtacaaataaagaaataagaagatcagcaaatgccacgtttggattcattgctgaagcaattggacctcacgatgttcttgttgcgttattgaacaatttaaaggttcaagaacgtcagttacgtgtatgcacggctgttgctatcggtatcgttgctaaagtgtgtggtccttacaacgtgctgccagtaatcatgaatgaatacacaacaccagagactaatgttcaaaacggtgttctcaaggccatgtcattcatgtttgagtacattggtaacatgtctaaggattacatatacttcataacaccattattagaagatgcactcaccgatagggatttagttcatcgtcagacagcgtcgaacgtaataacccacttagctttaaactgttcaggtacaggtcacgaagatgccttcattcatttaatgaatcttctaatacccaatatttttgaaacttcaccacatgctattatgcgtattttagaaggtttggaggcactgagtcaagctcttggccctggactattcatgaactacatatgggcaggattgttccatccagcgaagaatgtaaggaaagcattttggagggtgtataataacatgtacgtaatgtaccaggacgccatggtacctttttaccccgttacaccagacaacaatgaagaatatatagaagaactggatttagttctgtgaatatatatagagcatataaataaccacaacttgtaagaatattttacttgacacacctatatcatcacgtcacgatgccttcatagattatgatgaaatataaacagaacctgctattggaaaaaaaagggcaggaaaaaattttgtgaaagtgagtaaaagaaagatgaagagcgagacatggataataagaaatagatgtcactaatggacaattggaagactgatatggaaagttacgatgaaggaggcctagttgctaatccgaacttcgaggttctggccactttcaggtacgaccctggttttgcacgccagtcagcgtcaaagaaagagatctttgaaactccagaccctcgattaggtttgagagacgaagatattaggcagcagataattaatgaggattactcaagttatttacgagtaagggaggttaattccggcggtgaccttctcgaaaatattcagcatcctgatgcttggaagcatgattgcaagaccattgtgtgccagcgtgtagaagatatgctacaagtcatttatgaacgattttttttattagatgaacaataccaaagaataagaatagcattatcatactttaaaattgacttcagcacgtctctgaatgatttattgaagttattggttgaaaacttgattaattgtaaagaaggaaattcagagtatcacgaaaaaattcaaaaaatgatcaacgaaaggcaatgctataaaatgcgggtacttgtctctaagacaggagatatacgaattgaggcaattccaatgcctatggagcctatcctaaaattaacaaccgattatgacagtgtttccacatacttcatcaaaacgatgctcaatggatttttaattgatagcacaataaattgggatgttgttgtttcatctgaaccattgaacgcatcagctttcaccagttttaaaaccacttcaagagatcattacgctagggcgagagttcgcatgcaaactgctataaataacttaagaggttcagaacctacttcttctgtctcgcaatgcgaaattttattttccaacaaatctggcctgctgatggaaggttcaataacaaacgtggctgtaattcaaaaagatcctaacggttctaaaaagtatgtgacaccaagattagcaactggatgtttgtgcggaacaatgcgtcattatttattgcggctcggccttattgaagagggagatatagatataggaagccttaccgttggcaacgaagttttgcttttcaatggcgtcatgggatgcataaagggaacagtgaagacaaaatattgagcagacgacagattttcatatcaatgaagtttttttacaatagtttacaaatcatgattttacatactcaaatatgtgcaggttgatacagacaacgtacgtagaagacaacaaacagaaaacagcggtttatacatttatttaaatgacatacagtggagaagcagagaaaggaaaaggagtgcgatgagaacagaagatgaatacttcggttgtgttggttccacgtacacattaatagcattaaaaattgatcctctgaaattacttatgagttttacgtcttttggtatttggcgtttttccactggcaccaattgtaatgttaacctttggagggactggaaaaccgtaagactttgctactttggctaaatccagcttatcgatttgatagacagttttcaaagagtgggaagcgtacgcttgtaaataagatctataaccatccttggctgtttgatgtagataatagttggatttaattaatttttctaattgtgattgaacgtttgcaattttgttttccgggaattcgtactcatttaatgggaccttggaagcctttagatatcttaaaaaccctaattcattaggtgttaaaaacattaaagatttacccttacctttagtgcctcttgcggttcttccgactctatgaatataatctcttggatcatcaggagggtcgaattgaatgatccagtccacagcagggatatctagccctctagctgcgacatctgtacaaatcaagatacctctttccgcattacagaattcgaaaaatgtatttgttctcttttgttgtttttgcttaccgtgtaattcgaggactggcaaatcaatatagttcaataattcagcgtaatatttcacagagttacaagatgataaaaatacaataattttctttttttgatttcttttcaagaaagaaaataacaacaaaaatctcttatcactgtcacataccacatagccttgttctaatccatctgcggtggagttgtcggtttcaggaacgacattaatgaaaagagggcccggtctcagcgagattctagccaaatcctcaactttggtcgtttgtgtagctgaaaataacatggattgcctatcttcgtttggcaagatcttaattatctgcctcatttcatcttcaaacccaatttctaagattctgtccgcttcatcgataatcaaagccttcaagttcttgaatacaaatccttttgtattttgtaagtgatccaataatcttccaggggtagcaatcaacatgttaacacctttcatcaatttttcggcttcctgtcttctatttgcaccaccaatgacaataccaaatgtctgtgaatggaattccattaactctcttgccactccaaaaatctgtaaagccaactctcttgtaggcgtaatgacaattataccggtaccatttcttggtttgaatttcaaagaatgcaatagttcaatagcagggatgagaaacgctagagttttaccagaacctgtcttggcagcaccaagaacatccctaccggccaaaagaggtgggatagtccttgcctgaacagaagtcatagtggtaaaacccatcttttcaatggcctttaaagttggctgtgataactttagttcttcgaacttttccacacaagtagtttgttctccctcaggtgcggcattgttttgttttgaagtgctcttttcatctactacaggttcttctgtagattcagaatctctagaacgtttatttgacggggtagccatacttctcctgttaatattgctcagcttaactaattattatagtatacagttatccaatagctatgtactcaagtaccgtgtatacactataaaatctcatctcatcgctaaagctaatattgaaaaaaaaaaataaaaaaaagaaaaagcaaataaaaaattttcaattcgggtaacgaagaatcgactctcgccgggtaaacaattcttagtcgtcatacactcctccttacgttaagaaaatagaagtaacagcgctttgtaaagcattaaagtgtcatggattgcaaaatacacatagtatatcacttgtgatagtgggaaatggaatgaagtggtttaagatgctcttttaccaataaacatattgcgcctatcaaatcattttccacccctgttaactgatacagatatagccttacatataacttttgcactccctaaaattaccatggctgctcaccgcctgctatcatccatgtttttacatacatctattaggtttgccatcttagccgccgaagttatcgttgccggtacaggcgctccttgaataaccccctcccccccacgctattcttcaaattccgatttcagcttctctttgtttttccttttttggcaccccggaaaaacctccacgtgttaggttattccgccgattccacgggtggggtgctaccaagactcctgaaaaagaaactgtatgacgaaaagaaaaaaaaaagctgcttgaattccaacaccgctttcttgttctgacaatagaaagggggattcctaaaaaaagaaaaagagggcggggtttatcatgtacttaaaatatgaaaacgtgtcgaacggggatgacttcttctgcttctttacttctttctatttagagtgacagtttttttatttgttttgctaacttgtttatttattaatttcttgttgtctgctccttcagttacctaccacgactgtctcagccaaaccgcgatattttcatacaattgacattacaacagttcaaaaagaaaaatacacatccaggatatgactacagctagttcttctgcttcccagctacaacagcgcctgccggaagaaaaaccttggccgcaactgagtggcagcaatgcagacgctcaaaccttcaaatgtaaatacgtaaccaaccacaactccttgggcgatgggaattttagcgtcgtgaaagaatgtatgaatatacacacaaaggatttgtacgcgatgaagcttattaagaaacaaactgtcaagaacaaaattcaacttattcaaagagagttcgaccttttgaggtcaataagcgagaaaatcagagatatggaaaaaaagaatgaacattctttggacatttttgaggggcatcaccatattttacaacttttcgactattttgaaacggcagataacattgtcctgatcactcagctgtgtcagaagggagatttgtatgaaaaaattgttgaaaatcagtgtttagacctcgaaactcaagttacctcgtactgcgcctgtttggtgagcgttctcgagtttttgcattctcaaggtattgttcatagagacttgaaagcagaaaacgtcttattcagattgagagtgaacgaaaacgaaaaaaacctacagggtgaacaccacggagatttcaaatacgatctcttggcacatgacctagttctcgccgattttggtcttgctgctgaatataacacaagtaaggtaaactcgttaaaggagtttgttggaaccatctcgtatattgctccagaaatcgtcaagtgcaaaggtgtcggtgaaatgactcctgatcaagttggcaaactagacaagtatggttgtccggtggatatatgggcccttggtgtactgacatatttcatggccttcggctatacgccctttgactgtaccacagacgacgaaactctggaatgtatttcaaaatgtgactattacgtcgatgaacaaatgatgcacgaccctaaatacgagcaattttggaattttgttcaatgctgttttactattgacccggccgttaggcgttctgctaagaatttgaaacagcatccctttattaaggattattttgctacttcaaattctttgaatactaaggacacgccgaatttctcctttcatccaacaataagaagggtatcttctacagcgtccatgcacacattgaggtctccttctaaatcaagaaagacaactactctagcgtatttaaatatggatggcgggtcctctgaaacttccaccgccttcagcagcaagatggatttgcctgacctttacgttgatagaaccattaattctcgtgaaagatcattgaatagaattcgagacactctgaagaaaacattatccatgacatctcttaagcctgcaggcacattcgactatcttcacgctaacaaaaacggtacttctttatcatcatccaagtcaggcctcgtgaaaaagaattctacttttgtcttggaccctaagccaccaaagaatagcttgatgaacggttgtttcagcaccactccagaatcgcgctcaaatttcaatacccccaaaaccttatcgaggcaaggttcctctactagcgtgaagaaatatgtcaatgaagttgacttacttttaaccccacgtacggcctcgatgagcagcaatgataccacagccattaacgataatgatactactaacgataagaatcctgcaagaaaacacgcagcttcattccaggtgaatgttgatgattctgatggtgatgaaaccatgcagatatagtgttgaatgataattcaccttttttttctttcttttttttttacctgggacgacattctaactaatgaaatttacgattaattattcttttttttttttctaagaaacaaatataactgtaacatatatatattaattatgggggatcacaaagaaaaatagtaactttaagaatcaaataataatgtgttgcgcttcttagtactcatccggcatttacggtttccatggtatggtttatttttcgtgcatagtattacccgtcgtgttcttttcggacattggaaagttgtccatcccaaacacttaagatgagttaaaaggcgttggcgtttgccttctccgtgtgattgatttacagttcagcccagtgatcatttagcttacccatcatcgcgtaaaatgtggctcacagaggctcaaagtatgtttttaatattttagatgctctttgcttctccgagagacgttagttccttttttactaacaacttacttttcactagaatttggtgtggccttcactttcggcggttttctcttctttttgtttggcatatttactttttttgatcgtgccctattggccttgggcaatattttgtttttaattggagtattcttaataatcggttcacaaaagacatatattttttttaccaggccaaacaaaaggcgcggttcactatttttcctagttggtgccttcttaatactgttgaaatggacatttttgggctttataattgaatctctaggtattataggtctctttggtgatttttttggcgtcatcgtacaatttttgagatcaatgcccataattggtcccatactttctcacccagcaatcgctccaatagtagataaattagcgggagttagggttctgccagtataatggtaaaaatttgtatgtgaatatcatagattaattttttcgaactttctataggtataaagtaaaaataataatatttacatgattaacgttgtcctcacaaatttatgatattgactcgacaaaatctaacacagtggaatcatcaccatattgacctactacctgtaagccaatcggggtcttctcttttaaaggcattgataaacttggtagtccagccaatgacattgggacagtaaagacatcgtttatatacgagttagccggagatttggcttcctcttcttcgaagtcccttatgaatccaggaagcttggacgatgtgggaactatcagtatatctaggccgtctggatttcccttagaattagttaaaacatttggaaatctgaagatcccgtcaaattcatcgatcaaattaactcgtagcttttctgccttaataaaattgttcttaaatgcatctgaacaaagattataattacctagaatgattctattcttaacttctgttccgaatttggacctggtaggtgcgaataaaataccgtcttttatatcgagttctgaatctctgtatccatatctgataccatcataccttgataaattggaagccgcttcagcgggtgatagcgtataataaatcggtaaacagttttttacagatggaatggacacagggtatatttcaagccctaaatttatcagcttttctagtaaggataagtataatctgtgaaactcaatgggcatactttcatggctaaattcctttacaattcctacctttaaaggtctcctaacctttttattcccttctatcaattcacgcaattccacacttaaggaagtgggatctttcatgtcatatttatcgagcgtatgaaatacttttcgcaagacgtttatctttttgctaagtatgccaacagtgtctaaagattgagaatacgctattacgccaaatcttgacaaccgtccataggacggcttgaatcctaaaacagatccatagcatgcggggagcctaacggagccaccagtatctgttcccaaggcaaaatcgactagatcgcaagcaacgcttgcagcggctccagatgatgaacctcccatgatcttcttgtcctcatgaggatataaagggttaattacgggccctcttattgaatgtactcccccagaacccattccaaattcatctaaatttgtcttgcctaagatatgcactcctgcctgttttaatagtttcacaactgttgcatcgaagggagacttgaaattctcaagtatatgtgaggcacatgtggttggaaaatcttttgtaactatattatccttgatactggcaacgcaacctgtcaatgtttcttctgtaccttttttatttgtgattgaataaggagatggattgatactagtgaaaatattatattttgattgaaaactagataatctttcgattgattcttttaaggagcgtttcagtggcatttttgtataatcagagttaggactccaattgaggggccatctttccagcacaaataatagtgtttacaagtatagatgtactattacttttttgggagccaatgcatttcaaaaaaaaaaagaagagcagataagtcatgaggctaagaaagataaagaaatctactggttgatgaacgtcatagatttaagtgatcctgtcatcaatgtggattatgatagcttgattggcattgacaatgaggaatctcaagaaatttttgaaaatgaagtgaaggaagatggacaacaagaagagcaggaagaagcatcttcaagaaaagatgggctcatcgttgaaccagggagagatgttgagagtttgagaagggctattcgagatcagttgcttttcaagatacatagacaaaaccaatcagactgtgcagatgcgagaaagttgagtagcgatgaagaagatgaaagtcggcaacagaaattagaaagaataagagaagaattggaggagttgagaatagaaaatttaacatctgaaatgcaaactgaaatcaaggaattgtgcgaaattcaatcaaaattggcgacggaatcatctagtagattgacaaatttgaggaagaagcttctcgaaacatatgaaggccaagataccgtgatattgccaaacataattcttgatacgagcaatatcaaaagattgcaaaagttagatcagaaaatatccctgatggaacgttttgttggcataccagaagctttggaggcagaagaagataggaaatcggttcatagtaaagtcaatgaactatatcgaagtattcaacttttacaaggcgatgataaggcggaaggaaagctgcaaaagttccgggatagactcgtagaactgaacgaggaatttgaaaactcattgttaggcaagaaaatacaacaggacttgagattgaaagatgacaccgtgagcaagcttgttatgcccgaaaacaaagtaaaggagataaatggtatgtattccatgttcaagcaatatcaagattcactaccactgctggcggagaggatgaaaagtctcaataaaatgaacaacagggtgatcgaggtgtacgaaaccacgaaagggctggattcacaaataaccagcatccaagaacaaggaaaagtttggctaaaggctttaaatgagctggataaaaaattcgatgaacaagaggttaaaattcgcgaaaatatggagcagatcaggcgtaaaattgataccctcgaagacgaagctctacagagaaatagcaaataaaaggcggagaaataattttataaaccaatttaatttcattcttcattttttcgtctccatatgacaaaaaaattgaaaatatgtgtgtgtatgtatatataataatagtaataataacaatatgaaatatgaaatatccaaaataagagcggaaaacagaaattatcataaaaaagaaaaaaataaagtctctaaagggtatcaagcgcttatttcttcttcattctaccaaacaatcccttcttcttcttcttttgcttttcctcagtctgtacgtgttgttgtggctgatacactgcttgttcaccatacatttgactggaagcaccacccacttgctgtggcataccgttcgcatcgtaagtcacagcagcaccaaacacagggaaatcaggtcttacgcggaacccgtaagttggagtctccaactgttgggcccagaccgggtctccggagacagcatactcgaaacttcttatagtgtccaaaggtctttcgtctcttgccctagttggattcgatatatctgcctgtgtgatgggttgaccgaaaacatcacacagaacatgaccttcttcgttggaaaaataagattgtctgttcatgttgtcgtggaaggtatcagcagcttgttcaaaaggttgggcttcctgcacagcgtctagaataggatcagcaacggaagcagtacgcatcttcaatcttgccttgtcatcttcagaaatcttgacatctgaggcacggttcgctccgtcatgatcactcgtgttactgatactggatttctttctaaaatgcatcatattgccttggtgtgctgttttaaccttgtttgatgtttgctgtgtctcttgtgttagttctctgcctagtgaaaccgaaaatgctcaagaaagcgtaccacgaaagtactcctttcttttctattaataaataaacaaataaataatacaggttgctttgcctcgatggtaagaggaaagaaaatttcggatccgaaaatttttagcgcattctctgggcgccgtgcaccacgtcaatttgacagagatgatgttacgattattggtattattgtataaatatttatatatatgtgcgtgtgcatatactggctttctatttttatttattagattcttggcaacaggcaaggatggactgcttgacactttcgcaagcatttttgagttcctctggggacatggcggcgttacagcagattttcaagctagggacgattggtagcgtctcctgttttaaaacaatagtgtttcttgtgatgagaacgttgtagttaataagagcatgatctactatggactgcagaaatttttcctcctcttcgtatggctcaatgaatttgtttgtctgggacttcttttgcaaagctgacatggtttcgaatagttgttcgcaggtgtatccgaacttgcgagacctatatgcgggagtcagttgcagatgtaggacagcagacactggagaggacgtgacgattacgtatgaacgcaaggagtcgtcagatgcaaaggaatcatgcaaagatttggatagtttttgcagcgtctggacggcgtcgttgttggagtccatcaatttcaagactttggagacggatgtgacggtgtaagccggcaaacaggcagaaaaacagtatgcattggaaccaatacgctggtgcaaacacataacactgtcacccaggacaaaaccaccggtggaccccaacgcggtggccatggacccaacggtaatgtcaatggcagttgcgcgatccatgttgaagtgctctgacaacccacggcccgtagcgccaagaacaccaatggagaaggtttcgtcaacaaatagtctgaacttgtacttgttcttcagcttagtcaactcaggcaacggagctaaatcgcccgagttgtggaaaataccctcagtgacgataaattttcttggaatggcgggcagtttctcaagtttctcctgttcggtcaactcgtttaataaacattctagcgaattcatatcgttgtggttgaagtagtagactgtggatctgcttagttgcagagcattttgcactggtaatgacacttggtcgtctgccacgataacatcaccacgctttgtgaaagcaggcagaacagagggtgcggcacaaaagtcttgcccgtacagaacggaaccttgggtgccaaagaactgtgctaaatcatattccaacgtgtaatgaacgtcctgattaccgtagaacccggcgggaccacaggcgcccacaccgtaattcttgatagtggtcttgaccacttctttcacgggctccgtagcggacaattgcaaaaagttgttcgaggccaaattgaaaacattggtatacttctcctgcaggttgtttctggtgatagtaatatggttctgaatgggcatttccatggtgacgggtgttttggccaccctccacgattgctcatcggtggcagaagggtcgactagaggctcgggctcccagtcctcaattagcgcgtcaatctcttggggcgataggttgggcttctgtgcttgaagactctttttctgttgtggcttggacatataatagatgatcccgtataaaataagccctatctcaaccgtggtcctgtatggatcgtcatgatgcgatttcttgatgtacgaaacgatgaattggcctcccgggatttgagtcaacaccagattgaagtagtaccataggtacgatgaggtggtaacaataaatgccggaatcggtattgatttgggtaaaacctctgggatgtgtgccattgctttttttttttgggtgggaaggaagaaaaaaggataaataaccctacacgagcaaaatgtgtatattggaggccaggcagaaggttagagcgctcttatactgtgctactcgatgacgttgaaaagaattttttttatttttccttttctttttcttaagtactatattttctcaatcttactttcgttcactacagttaaccgcagcaatatgcccctataaaaagaaagagtgaaaaatttgttagcagagaagcaagaaggaaagaaggaaaaaaaaaagaaaccttgtaagaaatcatggcgcctcaaaaaaaaaatacgcgaaatctatttccgtatatgatgatacatatgttaggtctcttatggtagtttttagggtctgtcctgttttttgaaggcattggttagggtctagtaagtaactcgtataaagagatgtacttttatacggtatgtgtggcggttatttccagtttttttttttcccttattttgtgggttcatggaaatagtacatattgaccttctgcacaagaagccatattgacagagcagtatgtgaggacctttcttctacacaatgtaacagtcaatggttgtagtcaataccacgacccttacgtgcagttttagagcgaaacttcggttttttgagacttacctcgtgtttgtgtctccctgggaatggagccgcgccacccttgtctattatgtatagtcttatttaatcatagcgatgttggtcatccagtacacttcggtagcaaccttcgtttgtgattgtcttggtaattgcttccaacaactttatccatcattgagacaggggccatatcacccgcggggtctcaaagaaggggcacactaataaaagcaagagataagaatgccagcaaaaaagctccgaaataattcttttcgtcttccctcctagtcttaacaagacaagagagagagagaaagaatactcactagagattgtttcttttctactcaacttaaagtatacatacgctatgaaagcattcaccagtttactatgtggactaggcctgtccactacactcgctaaggccatctcattgcaaagaccgttgggtctagataaggacgttttgctgcaagctgcggaaaaatttggtttggacctagacctggaccatctcttgaaggagttggactccaacgtattggacgcttgggcccaaatagagcatttgtacccaaaccaggttatgagccttgaaacttccactaagccaaaattccctgaagcaatcaaaacgaagaaagactgggactttgtggtcaagaatgacgcaattgaaaactatcagcttcgtgtcaacaagattaaggaccctaaaatcctgggcattgacccaaatgtcacacagtacacgggttacttggatgtggaagacgaggacaagcatttcttcttttggacttttgaaagtagaaacgatcctgcaaaggatccggtcatcctttggttgaacgggggtccaggttgttcttcactaaccgggctgttctttgaattaggaccctcatccattggacctgatttgaaacccatcgggaacccttactcttggaacagcaatgccaccgtgatcttccttgaccaacctgtcaacgttgggttctcgtattccgggtcctcaggtgtttccaacactgtcgccgctggtaaggatgtctataacttcttggagttgttcttcgatcagttccctgaatacgtcaacaagggccaagatttccacatcgctggggaatcctatgccggccattacatccctgtttttgcctctgaaattttgtctcacaaggacagaaacttcaacttaacctccgtcttgatcggaaatggcctcactgacccattgactcagtataactattacgaaccaatggcctgtggtgaaggtggcgaaccatctgttttgccctcggaggaatgctctgctatggaagactctttggaacgttgtttgggcttgatcgagtcgtgctatgactcgcaatccgtctggtcctgtgttccagctaccatttattgtaataacgcccaattggctccttaccaacgtaccggcagaaacgtttacgatatcaggaaggattgtgaaggtggcaatttgtgctacccaacgttacaagatatcgatgactacttaaaccaggactacgtcaaagaagctgtcggtgcggaggttgaccactacgaatcctgtaacttcgatatcaacagaaatttcctgtttgcgggtgattggatgaagccttaccacactgccgtaacagatcttttgaaccaagacctacccattctggtatatgcaggcgataaagatttcatctgtaactggttgggtaataaggcgtggacggatgtcttgccatggaagtacgacgaagaatttgcaagccaaaaagtacgtaactggactgcttctatcaccgacgaggtcgctggtgaagtcaaatcctacaagcatttcacctatttgagagtcttcaatggtggccacatggttccatttgacgtccctgaaaacgccttaagtatggttaacgaatggatccacggtgatttctccttataaagcgtatatgtgtaggcacaccgtttttattatcagctacgatcgaaatatatacgtttttatctatgttacgttatatattgtagccttaaccatttgtaagttttgcttcttttcttttattcatttcataacatcatactgttttacgtaataccatccttaactttttccaccgaaggggagaaagaactaaattctagaaaaatgaaaccattaaaaaaaaagaaaacaatagagctgcttctacaattttgcacatcaaaaaagacctccaactaccgagtttgtaagtacaatgtctcaacccactcccatcataactacaaaatcagctgctaagccaaaaccaaaaatttttaatttattccgcgtttgcttcatttcattattgctgatcgctgcggttgaatacttcaagtatggtacaagaattaactatgaatggttccattgtaccccaatcaaagaaccccagtctggctcagtaatcaagctttgggcacgtggtgggccaagttgtgacaaaagaggcgaatataaaactatagtaaagagaatcactagagattatgaaccaaatgatgaacatctctcgttctgtatcatcgagaatgataatgttccacccgtccactacccaattcacgaagataaaggtgaacctggctacgtagcttatgtcgggtacgacacagactctgagctggttcaagaactatgtgctgattccacaatttatcacatgtgagttctttcttttacatacataaacatagaagaaatccaaccctgatatagggatttataaatgcgtgtgcatatctatatttatacatataaagagaaaaaaattgctcatgataaaagaagtatcgcctgcccactttcctaaatcctcgaattttccctatattttgcgaacattttgcctaattcctcttgaatattaactttgaaaacttctaaaggatatagtttatcaaggtcgataccagaggttgttttcctatcttctctgattttatcagttgttggtataaagtccatatatcgggccaaaaagtgttgctctttcacctcagtaggctcaaatctttcgtctactgtttttatcaatccaatagaatcgcaccccttcggtattaatatctcactgcgtttgaccatttcaatatgatctttcatatctctatcttcacaaaaatgctttagaagctcttggtatttaagcctttgtgcttcctctcgtttctcttcggtatggtcttcgcatatatagaatagtgagctatcattaaaatagcaaaacgatcttaacgtttgcaaaatgaagtcaatatgtactgactgccatactgtagtgtttctttgtaagtttaatatttcgccactgtttaagcaccatacagaaaattcattatcgtcattcagttgcttaattttattgaatgcgtaggatagttcattcagccacaacttttggtcgttcagtgtccaatctaataatatgagccagcgaaccttcgaactatgttcttgtaaaaacggctttagaagatctagtgcatcgtcagtgtttcttattagcgtgtaaacatcgacagaataattttcctttaagtcgttggtccatcctatggtggcgtaattaatcaaagtggtatccagtattgaattgcttccctctggaaaacagatatttataaattgatgcagtgttttacttgatggggaatatatgattgctgttatcgtagcagtctctgtgctgttgattgtggattcattctgagacaataatttgtcccaggcattacaattatccattaatacatacaattcttttatcttcttttctttttgtacaagctgcggattgcttctctttgtttacctttttccttttattttttttttaatacgtgcatatatatatatatttagtttaggtcagaatacaaagataattatgtataaatgggcgcatttggaaactattttacatacaactgaacaagttcggaacaatctatcaataatctgcacaattatataatccgatatcgacttcagccttcatatctgatgaattatttgcgatcgattcacgtttttcttccaattcttgaatataaccgtcttcaacaccagtgacataatttccggtaaatacaccatcttcgaatttggttattttatcagttttacaacaatcaatcaaatcttccaatgattggtaaatgactctttcacaaccgattacttccgccacttcttcatcggttctgttataagcaatcaagttctttgtgtctgttaagtcaataccataaatatggttgtaacgaatggctggggcagctgaagcgaagtaaacctttgttgcaccggattccttggccatgttaacaatctcttttgaagtagtacctctgacaatagaatcatccactatcagaaccttcttacccttaaattcagactccatagggttaagcttcctccttactgaagaaaccctttccctctggtttggcatgataaatgtcctgcccacgtatctgtttttaacaaagccctccctataaggcttccctaacacattagcacattctagtgcacatgttcttgcagtatctgggacgggaataacaacatcaatatcttctggcttcagttgctttagaatattttccgctaatttagaacccatagccaatcttgtgtgataaactgatattccatccaagacactgtccggtctggcgaaatatacgtattcaaataaatcaggtctataagagttaataggaaccacttgtttgaactcaggttcacctttgctacagttcttagggatgataactgcctcgccaggctttaagtcacgatatttagtaaagttgtgagctttgaaaacaacactttctgaagctaacatatagtccttggtgccgtccggattttctctttcaccgaacaataatggcctaataccatttggatctctgaaaccaaataatgcaaaaccggcaagtaaaccaacgcaagcataaccgccacggcataaacggtaaacaccttctaacgcgtggaaaacatcttcattgttaactctgtacttgttatgtttttccagttcagcagcaaaaatattcaatagtaactccgaatcactgtccgtgttaatatgtctatgaacgtcttcatccatatatctcttcaacgatgcagtattcaccaagttaccgttatgtgccaagttaataccgtaaggactattgacgtaaaatggttgcgcttctgaattagccgaagacccggctgtaggatatctcaagtgggcaatacccatggaaccagcaagaccggaaacacgttgttgggtaaatacgtcacgagccataccattacctttacattggtagattctaccacgagaaccacaggtagctataccagctgcatcttgtccacgatgttgtagaaaaatgcatccatcacataactccggagctactggagtggtttggtttgctaatacaatacctaaaataccacacattttttctattctgctgtttgctgtacctctttctttgctaaacttattagaacgaaatctactactttcaagacgatgtcttcgcaactatgacttaaaagtgaataaaattgtacggtggctgttgaaatttttctaaaatgaaaaaaaaacgaaggactttaccttgacttaataataagaatctgaaaagtacaaacctattattgaaattgtaagtaagcaaactttaaatacaccgaagctctgacatttgccgcatgagcagtcattcggattcatgatcccagattatattttattattcatgttcgttctaactctgtcctgttattttcggtcaggaagagtcaatacatcgggtcattgaaaaaccgcggagaaagataataacttttcttttttccttaaatcttgaaaaacttatacatgtataaatcaatatttacttacgagcgttcatagttcttgctggtcttttagttcattctctaaatgatccagatcttcttgtatggtccaaagttcgcggtacaatgaccctggcatagccaacagttcaagatgcttaccttcctctcttactcttccgttgtcaaggactatgatcttgtctgcatctgcaattgtcctcagtctatgtgcgatgtatacactcgttctcgaacccgaagtaaagttatctctaatggttcgtaagagagcttgttctgtgtgtgtgtccaaggcgcttgtggcctcgtcaaaaaacatgatccttgcattctttaatagtacccttgcaattgccagcctttgcttttcaccaccgctgatcatcaaccctcgctccccgacgatggtgtcaaaaccttgtggtaatttcttgattaagggtgctagctgggctttttcaactacagttatcacttcctcgtcggttgcgtcaatacgaccgaactttacattttcccagatagtgtcattgaaaagtggtgtgtcctgtggtaccacaccaatcaccttcctcaaggcatcgatgtcatattctttaatatctctaccgtttatgaggatccttccgctttcaggatcataaaatctaaagactaattttaaaatggtggacttcccactgcccgaagacccaactattgcggttttccagcctgctgggatggtaaagctggcattctttaaaattttcctatcgggatgatatccaaacgtgacgttctcaaaagtaatatcgtagggaacattttctggaagcattaagggacgttcggcatttttaatcttgacttcatttttccttaacttaaatagcgtttccatatcaatcagagactgctttaaatctctgtaaacactaccaagaaaatttagcggtactgatagttgaaaaaccaactgattaattagaaccaagtcaccaactgtcaagttgccaccaataacgccggtacaacccatatacatcattgcagttagggcagtagtaaaaattagattttggccggagttcaaaaatgctagagattgcgatactttaatttgagagtcacgatagttcatcaaggagccattatacttatctgcaagatatttttcattgttgaagtattttaccgcctcaaaattaattaaagaatctaaagccacactggcagctttgttatcggccttgttagcatcccttctaaaatgtgtcctccatgcggtcgtctttatagtgaaaatggagtataaaagcatcgtactgaatgttattgcggcaaatgacgcaccgaattgatacgtcaaaatcccacaaacgacagatatttcaaaacttatagggataatgtggaataccatggccgttaacacttgagatataccctttgtacctctatccatggccctcgtcagaccacccgtttgtctactcaagtgccatcccaaatctaacttcataaggtgctggaaagtttgtagcgatacagttctaatggcattctgtgccactttggcaaatacggcgttcctcagttcgccgaataaaacagagccgaaccttgcaacaccatagcaaagaatggttaatccaatcgctgccggaagggcgactgtaggatcatcccatgctatattcattgaatcaatagtttgcttgaaaaaaaaaggtacttgaacatttaaaattttggcggatatcaacagtccaagggcaatcagtacccttatcctcactttgttgttgcctttgggccaaatatagcgaaatagatctttcaagattttcagttccgagagggttggggccttgctggtcttttttacctgagtcttcacctttggagccgacgaggattgctcgacggattttttgtgcgtaatatccttttgtgcttgattccataaattcacagctgaattgaataacagaggccgctgggttgataacttagacacagtaaatataacgggcgaatggttccggattagaccagatctaaattttgatcttacaattcgcccaattacaggacatcttggaagaagcagcatttgcaggttggagtggaatctatcaacaacgatatacttacgttgctctgtcgcaattttcgaaattgtactctttgctgtgctgattgctttgtttgcgattattaatgtagaaagtcatcggaaagccctcgcgctctttcccagtgaaatttcacgtgatgtaatctgatgaagggcacgtataggtcagtgacctttgctgtgcaaattgggtaaggtaatttcttttaaagactttaagaatggtaaagtgaggtacaacaacatattataagacttacttggtatgtaccttaccttccttagatatttttcatgctgcgtagaaaattgcaccatctccaatcgtcacttttatacattttcaaaagaatatagatgagtatagcaatatagggtttacacatatgtacagaaaagcagaatagtaagttttgtttcattacttagataggtttttaatttcttcttcacatttggtaatgactgcattactggcattgattttaccggataaatagtccaatctggtcttgaaaagtttctgatcaggaactttccccaaaggttttaattcttcttcccatttcttgattctaccagtttcaaaacccacaacctttaataagtaacgggtttttagcacttttgcgagttcaggatcgttgatcaagtatgtgaatgctgccctgtatagtggtttggcaggcctgatttcctgtaaaacacccctatctctagatacagttattaaaccattattctccaattccatgattcccgtttctggtgcggctttgaataatggcttgttaacgatttcatggaatggaatgactgggttcgcactcaataattcgattaattcccaggcttgtgcacttttattgctgtcaatcttgtcacttaaaaacatttgagttatttgctcagaagcctgttcaatcattttgtctaatgcttccgagggctcttctcctgactttacccttcttacaaatgcctgtaagtctaacatcctaccacccaatggctctaaagaagcgtcaatttcctgtaattccttttcatttaaaataacctcagcttttttgacactcgtatcggcctcactatcagaatcattattttcagcagtttccttttctgattcaggttcttttacgttttcacccttggattttttattgtaatataagtaatcctccaattgggataatacatagttcctcgaattctcttttgaggcatctgataggattaggtttttgaagacttgattgggtagtgattcgctcaatctttggttggatgcaacggtttccgttaagaaaatcacatgagcaatattcatttgaactagcatagctgcccaatcggatagttccttatacacaaatccatttatttccgacttgccctcaaacctatctatgacgataacgggtttagcttccggatgttgctgtaggtaatcttcttccttaacattaactgtcccatcaccggtggaaacaaaagccttgtaattcttgagagcaatacgtctaatggacatcaatgaggtagttaacatgtttctaaactgagattccttcgtctcagacaacccagttttttgccctgttaatccttgcactgttaaatcaaggacacctgtgacagagtcaatccatgggaatattgggaaataacccaattgactagcggcattttttaaaaacttaggatctgttctggacttaatcaatttatcacaatccaaatacaaaacatttgctctattttgcaaagtgtgttgcatgaccaaatcatgtttccctgaacctctaggcccccttataaccacaaaagtattattattttcttcaagccacattttcaggtcattcactttctctattctttcctcccataaatgctttctttggtgattatcatcagggccgccccagtagtacttgatagaagtcatggtagatgaggttagcgttttcagttgcttccaaaacttattgtcccacgataaagaatatttgtgagtgatcttctgttcaatcgaaaattctcttataggatcaaacactaaaacagcaaagattgaaagtagcgcaaataaaactggaatagcaatccttgtatggttggtgaaaaaattactaactagatggcctcttatgatattttcgtattgtatgtgtaagacggtattatgaatttcgataccggaaacacaattcttggcagaaatggcaccacggaatgaacggtatcttacctttgccacattgttgttagcagcagtgggagggaaaatatcaataattgtcccatatcttctgaataaagagtatatttcttcttctgttaaggcgggcccttggaacttgatgactatagtggtacttggtagtcttcttaaatcctcaatccaaggcgaaccctttactgggaaggcagaagctcgagtgaagtacgagagtaagtttttagaggattctctggctgtattctgttggattagagaatttacctgagcttttgtatacttgggtggaacgacaaatgtggcaaatacaccaccatcccttttcactggaatggtagacttcaactccagtccataaatggggttattgggtggactggctaaattccttattttctccctcactgcatcccgtgactggtttcttagcaggagattgtaccacagtgttggattccaaaccgaggtggctctcgcgtaaacattatcgaaatatatcagagtttcttcatctgatttgtgaataacaccagtatcggtggcggtgtttgactctcctgcctgctgatccttttgctggatctcgctcgacacatgtctcactgagggttgggcattcatcaggttcgctagtctatatttgcccttgaggatgcctattcctctggcgaggcatggcactggcatccttgacacattcagggaagtcgttcgtactagcaacatggtttacttttacaaatactacttcctgtataggcccgctatattttggttttagatcctgtcaatactgagttcatctttcattttctcaatataacattaccgttatctcccttatacttctcaaattcccatctacggaaccctgatcaagccctgagaaactatatgagggtgtgtacattgcagtgcatcatttgtgagggttcaacaattgaaattatagggtggacgtcaagacgaaaagtgaaaaattacatccgtatagaattatataacttgatgagatgagatgagtaaatgacagaagaattaccgtttcatcattgaacttcgatcatttcaatgctggcatgcgaaggaaaatgagaaatatcgagggagacgattcagaggagcaggacaaactataaccgactgtttgttggaggatgccgtacataacgaacactgctgaagctaccatgtctacagtttagaggaatgggtacaactcacaggcgagggatggtgtttactcgtgctagcaaacgcggtgggagcaaaaagtagaatattatcttttattcgtgaaacttcgaacactgtcatctaaagatgctatatactaatataggcatgcttgataatgaaaactataaatcgtaaagacataagagatccgcttatttagaagtgtcaacaacgtatctaccagcaatttggcccttctccatcttttcgtaaatttctggtaaactggataagccaactacctttattggagacttgactagacctctggcaaagaaatctaaggcttctctggtatcagctctgttccccacgtaagagccgacaatggagatagacttgacaacgtggttgaagacatcagaggagcactttgcaccggctggcaaaccaaccaagacaacagtaccgttcgccctacagtatctggtagaagcttcgatagcggcttcggaaacggaaacattgatgataccgtgggcaccgccgttggtagccttaacgactgcgctaacaatgtccttctctttggtgaagtcgatgaatacttcaccaccgagcgaggtaaacaattcttcctttcctggaccaccatcaatacctaagactctgtaacccatcgccttagcatattgaacagccaaagaacctagaccaccagcagcaccagaaatggccacccagtggcctgctctcaagttggcagacttcaaagccttgtatacggtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggccatacatgaactgttcaaccatttaataccggcaagatcacccactttccaacccctaacgttgtccccgatagcaacaacgaccccagcaccttcgtgcccaccaactaatggtaacttagttggcaatggccagtcaccatgccaagcgtgcaaatcggtgtggcagacaccagagtatttgacgttgattaacaattcgttgggctttggctttggaactgggatatccttatgctccaacttgccgttggattcgtagaagataatggctttttgagtttctggaatagacattgtgtattacgatatagttaatagttgatagttgattgtatgctttttgtagcttgatattctatttaccaagaagaaacaagaagtgataaaaacaacaagagagcagtagtaagagtatttcgagtgtgaaaaaagtcgctactggcactctatttatatgtgataggcatgctatagctttaccaaaaagtgaaccccatttttatgctctcctctgtccttttttttttttctattctctcaatctgaaattctcttatttctccaacttataagttggagatgcccggtgttccggcagaggagatcagtctcgtgaagtggatggtttcccgcctgcgggcaaaacgtcataacatttnnnnnnnnnnnnnnnnnnnnnnnnnnnnnnnnnnnnnnnnnnnnnnnnaaacattagaatggtgattagaaaggcaggattaatcagttacacaggctgtaaccggagagacggatcataaggcaatttttagataagactggttagagttcttggcatcagaaaatttgagaaacgatttttccgtttgtttgcccctacgttttgcccctttgatcaaactatcagttaagatattaaattttttgagaaaacgattctttgattagtctcttcaaacaaacaatgagctctgaagacgaattgggaagtatcggtactgtgtttcccggaagtcccatagataagagcattgggagtattctcccacaatttgatgaagaagtggagactttgctggaagatagcttcacgtggaacattcctgactggaacgagttaacaaacccgaaatacaattcgcccaggtttagaattggtgatttcgaatgggacattctattattccctcagggaaaccataataaaggtgttgcggtatatctggaacctcatccggaagaaaaattagatgagactacgggagagatggtgccagttgatccggactggtattgttgtgctcagtttgccattggtatatctagacctggtaatggtgacaccatcaatttaattaacaaatcgcatcaccgattcaacgctctagatacagactggggatttgcaaatttgatagatttgaacaacttgaaacatccgtcaaaaggaagaccgctttcgttcttaaacgaagggaccttgaacataacagcgtatgtgcgcatattaaaggatcctactggtgtcttgtggcataatttcctgaattatgactcgaagaaagtcacgggctatgttggcttccgaaatcagggtgccacatgctatttgaattcgttattgcaatcttacttctttacaaaatacttcagaaaactggtttacgaaatacccaccgaacatgaaagtccaaacaacagtgtcccattggctttgcaaagagctttctaccaactacaagtatccgatataccattagacactttggaacttaccaggtcattcggttgggacactgcggaatccttcactcaacacgatgtgcaggaattgaataggatattaatggacaggctggaaaataatatgaagggaacatccgtggaggggaagttaaatgaaatatttgtcggaaaaatgaaaagttatattaaatgtatcaatgttgattatgaatctgctagagtggaggacttttgggatctgcaactgaatgtcaaaaatttcaagaatttacaagaatcttttgacaattacattgagatggaactaatgaatggtgaaaatcagtatgctgctcaagactatggtttgcaagatgctcaaaaaggtgttatattcgaatcatttccgccagttttacatctgcagttgaaaagatttgaatacgattttaattatgatcagatggtaaaggttaacgataaatatgaatttcctgaaacaattgacttgtcgcccttcgttgataaagacgtattaaagaaaacgttagactcggagaacaaggataagaatccttatgtttataacttacatggtgtgctagttcattctggtgatatatctaccggccactactatactctgattaaacctggtgttgaagatcaatggtacagatttgatgatgaaagggtttggagggtcacaaagaaacaagttttccaagaaaattttggatgtgataggttgcctgatgaaaaagttcgtacaatgacgagagatgagtatcagaactatatcattcaacgccatacaagtgcttatatgcttgtttatatacgtcaagaacaagaggaggatttgctgcgtccagttttggaatctgatgttcctaagcatgtaatcacaagagtaagagaagaaatcaaagaacgggaaacaaaagaaaaggaaattagagaagcacacctgtatgtcacgctcagattgcactcaattaaagagtttattcattatgaaggatttgactatttcgcacatgatgggtttaggttatttgcagaggagctcaatgactctggtttgcagcaaatcaacttaaaggtcttgagaacaactaagttatcggatatttttgcaagcattaaggaaactatgaatattccacaagaaagggacgtcaaatattggaaaatggattatcgcagaaacagcactttgcgtttaacacaacccataaattttgaatccgtaaacatcactttgcaggaggcattaaaaaaggagaagaaaaggactatgcaaacgcaatatggagaggaaggtgttgctagtactgaggaagacgacaaggcacttttagaaactgtatcattcttagatcttttcattgaggagccctatctagagttacaatttttgaacaagctgaaggaagcttctttaatctcaaaggcccagctggatgatgagctgatatcaactataagaacgaatcttccagaactaacaaagggaggaatcgagcctgtttttgccaccgacaataaatctaatttgctattcgtcaagagctacgacccacatacccaaaagctattgggatttggccattttgccgtaaatcaattgcaacagctatcggatttatctgcaattattgaggacagcatttcttccaacgaaaagctgactttctacgaagaagtccaacctggtaccataaatgaaatatatatgaaggagacaatatatgatgctgatatagacacgggtgatatagtttcatttgaggttccaggtgctgttttgccagatacttttcctgtttacgcaacaatcaaagatttttactcatatctgaggtatcgtgtaaaattgaagttttctaaatttgacggttcaagtgaggaatatggagttagtaatgaaatcccagagagcttcgaattctggatatccgcttatgcaccttatgatgaccttgctagaatggtgtcgaaatatgcgcacgttaagccagaatatctaaagatttttgccctttattctaatggaagatttgtgttaaaatcaacctcacttttgaatgattaccttttgaaagatttcaattgcgatcaaataccgccttttgcatttgaagtattgtctgtgcctttgaaagaattggagcgtttgaggccaattaaattatattggctaaaaaatagttatattcattatcaatgtttcgaattcgaagtcgcaaacgattatacagaatctcaatttcttgaaaaagtgcaacacaaaatcggctttaccgatgaagaaaaggagaacatcttactctggaccaacacaaatttccagtttcagggcttattatcggaccaaaacaccttcaaagatgtgagtaaaaattctttactctttggtagaattttacccgaggagtctaaattgttcaaagaattaaatcgtctagaaaacgtacaaacatcttcattggaggattttatggatgatgaaaacgcgactgacagaccaatggacgatgagcaagatctaggtatggcgatagaacattctgaagatatgaaagggcgtatagtggttgttcaacaatatttcaaagaccttgagaatagacacggaatatccttcttattcaatttaataccagacgaaacattcccaaagacaaaagatcgtcttcatgcaaaatttggtctcggacaaaaagaattttcaaagatcaaattaagtattggttactccactgaagaaggtacggtgtttagaagtttgcaaggattttcggacgaagaattggacaaagttatattgtatgacattatgtccaacttagattatatctacatggatcatccggatagattgagatcgcattcttcctatgatagaccaatgatcattaaaaactgatacgtcttacgactatgtttagctttgatgttttctccattttttttatgtttttttatgataatctctcagccgccatcacttccacacaggcaatgttctacagttttattttgcttttaggtaatgccgcatatatatatatatatatatatatatctttataagttggaacacaaactatagagcagcgaggacccgtagctaaaaggaagacaaattgaaaaatctttcacaaatgagtatagaatatatactttacacaaaacacataagtaaacaataacgtgataagaataggagagcaaatatgggaaagggcttatttcccccatatttggctgctttttaagaaaaagggaaaaagaatgatcataaagtaaatgaagtttcagtggtttaatcacttgatagaataccccagtatttttcaacaccgtattgcccatcatctttccatagatcattgaaggcggtaaataagtaagctgaagagccgcaggagcttttgatagaagaaatggcggcttcttggtttgctttagatgggacagcttcgccgtaagtatcacccttagatggccaaccagtttcggtaataacgacgtcctttttcccaccacaagcagtgtaaaccctttcgatttgttctagtacccatggtcctgcatcttgggccgcagtattttcatcgaagtatgcatgggcgttgacagccatatagtcagaataattacacaggtcagggttgtttataacagcaatgaaggtatcaacggaaacgactgagcctgtataaccagcagaggttaaagctgacttggccgtggaaacgtattcaccgacttgcgtcgtagtggcagaaccgccattgaccagttcgttaccgacagaaacagtggtaatatcatcccaggagccataagactcaactgcagatttaatagtatcaacggcgtcttgaattttgtcaacgtaatatatgcctaagaataatttctggcttgaagttttagcttgcaagacattctcaacctgactacagtcaacgccatataatctgatgttgtcaaaaccagtcaactgttctaaatctgaggcgacttgagcagtagatttacaggacccatcatcattgtaaggactgtaagtaatacccttagcaccggaggctgagatactagatgaagcggaggatgaagctgaagatgaagttgaggatgaggatgagggtgaggatgaagtcgaagaaccaaccgtagatgctgcctcggaagattgaagagtgctggtttgttgttgagaagtgacgacattagcggaagttgttggttctaaagtggatgtagttgcttgagaagcaactgcagtactgctggtagtagctacaacagcattctcgttcactggaacaatagtttcgccgctgttaccggaaacaacaacagtaacctgcgcatggactgtggcagtaacaacgtcacgcttttcatgtttatggcgaacagcaggagcacctagagctccggttaataatgcagatacagttaggaaatttgaaaaacgcataattgaatgaaaactttttttgcgttaatactatcttttgacaatttgaaaaaaagaacagtaatagtaaaggagagacgtgacagttggatgttcagctcaatattgcaaaagtatagtatttaactcttttatttgggtctatataatagatgaatttaaaatgggaaaaatatgatgcacgcttcaaagatacattgtaagacaaacttcacgcagacatctttccctccattataaatactacagttttgaaacaaacgtggaaaagaaggcttatggatacggctctcgatggagaagttactgtacacatgaaaacacgaataactttcaaacgcgtgcgacgtttgttaccatattcaaacgtttcaacgcgaattttttgtccgctgtttcgcgcaattaaaagtcttggcatttttctcttcaggttttacttcgtccgaaatcttcgaggacttttccgaaaaaggtaaattactgcaaacggtctttcgcgaaatctagaccgaagatctctggggatatgtaaggaacaaatatttttgtcattgagggcttagataaaaagaaaatctagatgtcttgcctgagaaaaagaaagagggaggcattctttcttaattattaccgtgcctggtatcagcataagtgaaggccgagacagctttcgtatatggctgttgcacgtctctgaactaatcattctcgcccatcaagatcggaccatcttgcctagtgcggcaatgatggttaaattatgcgggtaagagttttacatggtcagcggctatttggcgagaaccttcaaaagtaattatgccttctaggatttgccactatacaacttaatcattaagggctgtggaactgcatattgggaaaagaaaaacatactgagaaggaaagttaaggagttgaatatggattttatgagtcccaagttttcgctaactgacgttgagtatcctgcttggtgccaagacgatgaagtcccaataacaatgcaggaaattagagaaatttttgtggagctcatggataagtttggcttccagaaatcttctatggaaaatatgtatcaacatttaatgggacagctggactccagggcaagtcgtacaggtgctcaaaatgctttagtatcgctacatgtttcatatattggaggcgaacacgcaaattatagaaaatggtattttgccgctcagctcgatttagatgaagagatcgggtttcaaaacatgcgactacatggaaaggcacgccaaagaaacgtaaaaatggcgaagaaaagaggcgtatcgataaaggaacaaattaagcaatggaatgagaaggagcaagagttcatcaataaccatccaaagatcacactgactcaagaacaattggaagatcagacaaacttgaaaagtgcagactacaaatggaaattgaaaatgaaaaaattgacgcccgaaaatatgataagacagctggccctttatttgctttgctggggtgaagccaatcaagtcagattcgccccagaatgcctttgctttattttcaaatgtgcacttgattatgatattagtacgtcaagtagcgaaaaaacggtgaaatcacctgagtattcatacttaaatgacgttattactcccttatacgaattcctaaggggccaagtatacaaaaaagacgcaaaggggaactggaaacgaagagaaaaagaccacaagaatattattggttacgacgacatcaatcaattattttggtacccggaaggatttgaacgtattattttaaacaatggagaacgattagttgacaagccattggaggagagatatctttactttaaagacgttgcatggtctaaagtattttataaaacatatagagaaaccagaagttggaagcattgttttaccaatttcaatagattctggattatccattttgcaccgttttggttcttcaccacatttaattcccccactttgtacaccaagaattatatacagttattgaataaccagcctacaccccaagttagactatcagtgattgcctttggaggcacaattgcatgtttagttcaaattttagccaccgtgttcgagtggggatttgtacctcgagaatggccaggcgctcagcatttatcgagtagaatgattggcttacttttttgtcttgcaatcaatttgggaccttccgtgtatgttctggggtttttcgaatgggatgttcattcaaaatctgcgtatatcgtgtccatcgtccaactaatcattgcatttttaaccacttttttttttgctgtcagacctttgggcggcttatttcgtccatatttgaataaagacaaaaaacatcggaggtacatctcatcgcaaacctttaccgcttcatttcctaagctgacaggacgcagcaaatggttttcttatgggttatgggtatttgtgtatttggcgaaatatattgagtcctatttttttttgaccttgtccctcagggaccccatcagggtcctctctattatggatttgtccagatgtcaaggtgaatatttgttgggtcctattctatgtaaatggcaagccaaaattacattagttctcatgctgctttctgacttgggcctgttttttctcgacacttacctttggtacattatttgcaactgtattttttccattgtactgtcattttctcttggtacttcaattctcacgccatggaagaatgtatactctcgattgccaaaaaggatatattccaaaatccttgctacttcagagatggatgtgaaatttaaagcaaaaatactgatatcgcaggtttggaatgccattgttatatcaatgtatagggaacatcttctctccattgaacatttacaaagactcttgtttcagcaagttgactccttaatgggagacacaagaaccctgaaatcgcctacatttttcgttgcacaagatgattcaacgttcaagtcaatggaattttttccatcaaattcagaggcaaaaagaaggatatccttttttgcccaatccctggcgacccccatttcagaacctgttccagtggattgtatgccaacttttaccgttttggtaccccattattcagaaaagattctgttgggcttgaaggaaattatcagggaagaatctcctaaaagtaaaatcacggtgcttgagtatttgaagcatctacaccctacagaatgggaatgttttgttaaggataccaaactactaagcatggaaaagagctttttgaaagaggcagagagcagtcatgatgaagatagattggaaattccggatgctctgtacgatccaaggtctagcccgctttctgaccatactgagtcccggaagttgcccacagaagacgatcttattaaggagaaaattaatgatttgccattttcttactttggcttcaactcatcagaaccatcgtacaccctgagaacaagaatctgggcatcattgcggacgcagactttgtaccgaaccctttcagggtttatgaactattccaaagctattaagctactgtatcgaattgaaaacccctctttagttagcttgtatcgtggcaataatgaagcattggagaatgacttagaaaatatggctagcaggaaatttaggatggttgttgctatgcagagatatgcaaaatttaataaggatgaagtggaggcaacagaactacttttaagagcctatccaaatatgtttatatcttaccttttggaagaattagagcaaaatgaatctgagaaaacgtactattcgtgcctgactaatggctatgctgagtttgacgaagaaagtggattaaggaagccaatattcaaaattcgcctgtcgggcaatccaatacttggcgatggaaaatcggataatcagaaccattctattatattttatcgtggtgagtatattcaggtgattgatgcaaaccaagataattatttggaggaatgcctaaagatacggtctgttttaagtgagttcgaagagcttgagcttaatcccacaatcccatacattcctggcattgaatatgaagaagaaccaccgcccatcgctattgttggttcaagagagtatattttttcagaaaatattggagtgttaggtgatattgctgcaggtaaagaacagacttttggaaccttatttgctagaacgttggctgaaattggtggtaaattgcactatgggcatcccgattttctcaatggcatttttatgaccactcgtggtggcctgtctaaggcacaaagaggattgcatttaaacgaggatatatatgctggaatgaacgcaatctgccgtggtggaaagataaaacatagtgattactaccaatgtggtaagggtagagatttgggatttgggtccatcctgaatttcactactaaaataggtgcaggtatgggggaacagctactatcaagggagtactattatttggggacacaacttcccatggatagatttttatcgtttttttatgcacatcctggtttccatctgaataatctttttatttccttttcggttcaactgttcttcgttctgcttttaaacttgggtgcgttgaaccatgaaattatagcctgcttttacgacaaggatgcaccaattacaaatcttgagacacccgttggttgttataatattcagcctgcattgcattgggtatcgatattcgtactatcaatcttcattgttttctttattgcctttgcccctttgctgattcaagaagttttggaaaagggtatttggagagcagcttcaaggttcctacatcatcttctttcaatggccccattatttgaagtattcgtctgccaagtttattcgaattctctattgatggacttgacctttgggggagcaaagtacatatctacaggtcgtgggtttgcaataacacgcctcgatttttttacgctctattccagatttgttaatatatcgatatattctggtttccaagtgttcttcatgttattattcgcgattatttccatgtggcaacccgccttattatggttttggattacagtcatttcgatgtgcttcgcaccttttattttcaatccacatcagttcgcattcatggatttcttcattgattataaaacctttatccactggttattctcaggtaacacgaaatatcaaaaagaatcgtgggcaaactttgtcaagagttctcgatcaagatttacgggctataaaagtaaaactgtagatgatatttccgaagattcaggccatgattcaaagaaagcgaggttttggaacgtcttctttgcagaactatttctacctttctgtgtgttcctcttcaacttcaccgctttttctttcattaatgcacaaacaggggtctctgactcaacaccaactagcgctgttttccgtttgttgctcgtaacttttttgccaatctttcttaactcaatagtgctttttctattattttgggtttcactttttgtggttcctggattgtcatattgttgtaaagacgcaggtgccgtgattgcgtttattgcacacactttctcggttttggtctatcttttagatttcgaactgatgtggttcttacaaggttggaactttacccgtacattgatactgcttattacgtgcatcaatatgcatctgattcttttcaaggtctttacgacgatattcttgacaagggagtataaaaacaataaggcacatttggcatggtggaatggtaaatggtacaatacgggcatgggctggtctatcattttacagcccatacgagaatacttcgtgaagattatggaatctagttattttgcagcagatttctttcttggtcacttcctcttatttatacaaacgcccataatattgttaccatttatcgattactggcatacaatggtgctattttggatgaatccaagaagtattatcgcgcataaaagaattttgactcgaaagcagagagcattaagaagtaggatagtttcaaaatatttctctctatattttgtgatgctaggtgtgctcctttttatgctcatcgcgccattctttgctggtgatttcgtatctagtccgcaagaattgctggaaggcacccttttcgaaggaatcttccaacctaacaaccaaaacaacaacgatactggtccaaatgctccatcgacaatcctgactacaacaccaactttacctacctttaggactgtcgcatagggataaaaaaaaagttattttgagtagctgataaagcgagctggtgcctatcatagccggctcagactttcatgaattcacaggccagccctggctattcttttgcgtacttttagttcgatatattttcgcggctcgcgttttgtttgcttcttattttacactgagttttcgtgccgcaaacgtggagatgggaaaaagaaaagtcgggaaaataatgagaaatttctacttttggtattcctcatacagcctgcgcggtttattagtaaaatacccgataatcctcgaggtttgaaaaacttttccctctactactgttgacacggatttttttatttaagaggaaaagtcgtggttgttttcctcgaacaaattagatatccataaatagttgtgtcgttttattaagctatttcaaaatcagtttttattttttaaagtctgataaaacaaaaacaacaaacacagctaaatctcaacaatgttgtttaaatccctttcaaagttagcaaccgctgctgctttttttgctggcgtcgcaactgcggacgatgttccagcgattgaagttgttggtaataagtttttctactccaacaacggtagtcagttctacataagaggtgttgcttatcaggctgataccgctaatgaaactagcggatctactgtcaacgatcctttggccaattatgagagttgttccagagatattccatacctcaaaaaattgaacacaaatgttatccgtgtctacgctatcaataccactctagatcactccgaatgtatgaaggctttgaatgatgctgacatctatgtcatcgctgatttagcagctccagccacctctatcaatagagacgatccaacttggactgttgacttgttcaacagctacaaaaccgttgttgacacttttgctaattacaccaacgttttgggtttcttcgccggtaatgaagttactaacaattacaccaacacagatgcatctgctttcgtgaaggcagctattagagacgtcagacaatacatcagcgacaagaactacagaaaaattccagttggctactcttccaatgatgacgaagataccagagttaagatgactgattatttcgcttgtggtgatgatgatgttaaggctgatttttacggtattaatatgtatgaatggtgtggtaaatctgacttcaaaacttctggttatgctgatagaactgcagaattcaaaaacttatctattcctgttttcttctctgaatacggttgtaacgaagtaacaccaagactatttactgaggttgaagccttgtacggttctaatatgacagatgtctggtctggtggtatcgtatacatgtacttcgaagagactaacaaatacggtttagttagcatcgatggtaatgatgttaaaactttggatgacttcaacaactattcttctgaaatcaacaaaatatcaccaacttccgccaacacaaagtcttacagtgcaacaacaagtgatgttgcttgtccagctactggtaagtactggtccgctgcaacagaattaccaccaactccaaacggaggcttgtgttcatgtatgaatgcagccaatagttgtgttgtttccgatgacgttgattctgatgattacgaaaccttatttaactggatctgtaatgaagtcgactgtagcggtatttcagcaaacggtaccgccggtaagtatggtgcttactctttctgtacaccaaaggaacagctatctttcgttatgaatttgtactacgagaagagtggtggtagcaaatctgactgtagcttcagcggttctgccactctacaaactgccaccacgcaagctagttgctcctccgctttgaaagagattggtagtatgggtaccaactctgcatcaggtagtgttgatttgggttccggaactgaatccagtactgcctcttctaacgcttcggggtcttcttccaagtctaactccggctcttctggttcttccagttcttcttcttcttcttcagcttcatcttcatcttctagcaagaagaatgctgccaccaacgttaaagctaacttagcacaagtggtctttacctccatcatttccttatccattgccgctggtgtcggttttgctttggtttaaaaagcttcgacacatacataataactcgataaggtatggtatcttatttcattgtggggtagtttttacgaaaaaaatgaaaagttgtaagtatagtatatattttttttctatgtaagttttataagattctattcgctattaccaccggtaaattaaaaagaacactattgttacattatatgtttttaaatcatcaaaaaagacaatattcatttaatattccttatagaactacttaacattgttcttctttctattaaacgtctttatgcaaaccatttatgtactttctccataatatcagctggatatctattgaaaattgccatagcatcactagaaggcaaaaatcccaacaactttttaactgaacttatcaccgtttggccttccctttcggtcaaacttctctcattcaaggcttgtatgactgaatcaactacagcggagatattagattgagcacacacaattggcgaattattttcaatcaattgactcaaaaattgatagttgaatgaggcagcttctttgtcagttattgttggtaacgttttgaaccaattagccgtgtacgtgtctacgttaggaatgttggaattgtatgcataaagaattttggcgatggctgcactggcattctctgttgaagaacgattttcttccagtttggagcctggaaaatcgacaatctgaacaagtgtatctaaagtcggtatgcaaacgtcagcatatgtagatggagcgtattgggcacaaacaccgattatataagaagcagcttggcgaatacgagcgtcaggagaaatcaagcactcggtaacctttggaataaatgcgttcttcatgctagcagtttgttcgccaccatattgaatcaagtcaccaatcactactaatgcaaaaatgactaaaattggttcattatctaaaaggaatgtgtttatcataggccatatattctccaaattctttagataatgaccatttgtggttttcaaaacggccgcgatagacttgttgatttcatcgagaagatcttcgtcagtaaagtcttcctcttcatcaatattttcattatattcatcaccatcaccatggcgatcctgcatcctttcgtaagtgtcagttaagttggcggagacacccttagtaaatgccgctaattggtcttcgcttaagcaattgtcacccatgactttaataccattcactaacgagttgtgataaacttgcgtgatttctggcattggttctgacattaagcctccgattagtttagacgaagctttatgccacaacaataccaattcctcgttttgagtaccggtggctgcaagtaaacaagataatagaataggaattaaagttgctcctgcagcacgaacaccgtcatgtaggtaaaagtcaagcgatggtagagctatttcttccattacttctttaacatatacagcaaattggcctcttaaaagtgtcgcatagctttgtaatagctccattgctgatactttatcgtcaaggacggatgtgtgaatagcaatgtgttttccctgaacttgaacaacatcccaatctggatattgttggaaatttgctgcttcttcttcttcaattaaaccgacgtcttgcgttgctttggcagtaattagcaggggtggtataacaatcggtaacaacggaacaaaatcatcacccagaattcggcaaatcctgctccaactttgttctaagtatgatctgagcgcatcatcttcatcgatatctgagttttgtaaagcgaccaatatagaaatcagctcttgagagtgctcatgaaatttttccttaccaacggcaaaaccaatcagagttgcacattccatacatttacctttcaaaacactattatctttattgttaaccttcaaaacatttaataataatggcattagagtatcgtaatacttgataaatttattctttgcagcttcagcaataaatgcaatggttgttagggcctgttcctgtacgtaaagtttgttgctttgtaataaaactaataaatttgtcaatagactatccaagtaaggctcaagaatatccttcgaagcgaattcagaaaagttaaccagagccgctgcggcgtgcgtttgaactcttgaggtgcattctgacgttagtttagatattaaagccggcaaaattctatcgtgtgcagttctttgaatgaatggtgaaaaatcagtagatatttgacccaaaacattacaacatccatactgtactcttggatgaggatcgttgatgaggggaattaccatatccaggatttttgggatctcgccgatcagaacatcagcacaaccctcagctgcagaggaaagtgccatcatggccgcgaatctttctctccattcggttgatgtgatcatttgctgtaaatattggaacaatggtgcagccaaatattcaccacccagctttaaagcaacacgatcaagagcttgacgagcgtggtcatatgtaacttcctcttcatcatcggtatcgtcagattctatccattctgctgcatcatcatcatctatggatacctccgtcatcatgattaaagtaaccatcactaaagtttgcccgtaattctggttcgatttacacatttggggagcgttctcgctgaaaacggttagcagttcgagtgctgtggttcttgctggaggttctaaatccttattttttataaccatatcagtgaattgtattatttggtcaaacatatccttgaatagttttggtgccaattccaccaactcaattaacgattcaaaaactgatgcaagggcatcgtccttaccatcatctaaaaatcttggtaaactattcaaaagacttggtaataaaatacctaacttggaccactcagattttggtagttgcttaaaataacccacgaaagccgtaactgcagcaattttgacattatcacttgcatcagtaaagcctgattgaaaaattggtaagatactgttgatgtcaacagcggtaattaaataaggtacagtcgtcaaaattctaaaactggattctctaaaatttgggttaccgctttttaaagactctattaaagcttgtagtaattctggccatgctggtaagtcgtcttgaacacactcagcaatagcatcagatagtttgtgcctaattgaatcagctctttccgacaaaaacccttttaacaatgaagaacgaatttgtgcaagaacttctttcctaatatgtgtgatatttttggacataatcataagcttcgaagaagggggagcttttaatgctaattttctaaacagaacagcagataatgctgcaactgttgtatcttgggagaaagcggcttgttcagccaaaaaagttaaaagatactcaatattgttttcggtaatccattcttcactaagagccttctcagctacagaacgtatttgattgtcaggggaagcaaacgcctggacaatctgaagtaatgttctattaacttcttccggtaaagcagacatagcgatggctctagttacggttgaaatcacgtgtcgttaggataaagtggcttgcaagctaattacttttgtttgggctatctgccactttgatctactcagtctattagccactcggtatctgaagagcgccgaacttcgatcactgttatagctgtctataatactatagtgattattggaccgtctggtattagtattcccatttttttagtgaatttcatttttctttttttcctgggtagaaaatgaaaaatttttcagtttctgcaaagaattgatatcgtgcgtcatgatgataataccgatttactgcagttcgtacaatttatttttttttttagaatgtcaaacagatagtccatgataggctattggattatttatcaacactcatgatccatatattttgagattatatttgatgaagaaataaagcggcatatcatacttttcttaaagtttaatagtttgtattatattataaagagtgtttacgtaacaaaaaaaactatatatatatttgcttatgtgtaatgtacagtgaagacgattagattcaaaccctaaaactaaaaataaagagatcgctaaaagaatcgaaaaaaaaaaagatgagcaatatcaagaataaaaagcaaaagtgaatatggtttatactctcctgcttagtttccttctatattttttggttgctgatgttattcttctatctacaatgattttttgttaagaatgctttcgaagtagtttttgattttattgatcaacgacgatttgatggtgggttaagacgttctttagcgattttatattctttgttcaattttaccattgcttcttccaatttagtaatttcatcacccttttcgacaacaaagatggtcttctcgtcgtttaatttggctgggatttccaattctgcgataacagattgcaaaacttcaaccaccttattttctggaagatcaaataattcggctagtttagcaacagaaaaacttgaatagaacctcttgaaagaaaagaaataagtcttcaaagattcaacttgtactctttccgttaaactattcaacaccgtttccatgtttggtaataaagcccaagattttatttctcttaagtatttaacagagtctctccagttacctttttgcattgatttggcagcaaacaagacataatctcttaaagtttctggtggaccttggaaacttaacttgtcgtaatgttctaaggaacgacgaatggattttggagagtaaggaattctcttgaccttaataccggaatagaaggcagtcattcttggaatttcgatcaataaggaacatgttaagaagacgacatcgattaaatcgagattgatgtgttggtgatatggcaaacattgtctagcacgctcatcagctgaagcattgttactagaattgagagatattctgtgtagggattgttggcccaaaatttctcttaagtgagaacttgacagaagatcattcaaaatttgatgacattcttcaatcaaacataatttaaaggcggatagacccaattgaacaacaaccctgttgaataaaatttgtagggatgaatcgaattggttgatatttgtttgaacttgggaagttagtaacatatctttagcagtttggaaatctttgtttaatgcagtgtagtaaatgttgtataaaatagcacgtttttgaacagcaatgttgttttgcttggataagattgtcgataatccgtctattaaattgtcgacataatcagcagaatcgagctggtcttttgaagtaaatttagatttgaattgagcaggtatgatattccaagcagcagtttccataatttttatcaaattttcggatttatagtagatatgatccaatctcttgacgaatggacgtgtcaatgctctttctaggtcgtgttcatctttcaaagtcgcttcaaagtacaattgagttcttaggatcaaattatagattgattgttcatcccttaaacggatcaaataatcactggaatgaggatcgatgtttaacagggatttcatgaattcgtcatctaatctttcaacaaatgagaaaatggaacccagaatcctcttgacaccatcagaatcttctttaggttcatcttcaatgaaatcgattggatcagcaaattcattaacttggtaggtgtcaattgtctggtctaaaatagacaataatttactaatatcgttgaatgaagatttccattgatcaattggttggtaagataggttagctgaggcatcgaatcttgatggaatcaaagtcaaataagccattatgaattcatatggtttttcagctacagttaataactcctccaaagtagaaatcaaggattgttgattgacagtcttcttacctcttgagtcaattattgtttgtaatctagtgaagaaatcttcttgtaccgcttggtcattgccttgagacgaagaaattgtgaatccattagcagaaatatccaaatctgcggttggttccttatcaaatgattcaggatcatttctgaatttagccattgagtcttcattttctctagaaactttcttgactctttgctttgtagtgttataagctcttgcaacagctttattcttcaaatcagcttgttgtgtattattcacagcgtcctccacttgggcaacaaccttgatgaaaatatttggagtcccccagttttgttgttgagccctaactaagagacgcgagatcaaatcaaactcattagaaatagtcaaccagtcatcagagttctcagcttgagagatcttattataaacgtcttgcatttcatccaatagtttttctttggcagacttgactaccttcttgccatcttcttcatcggattcttcatcactggaatcatagttagagcttttcaaaaatttatttgaacctccaccttgttttctgaactcagatttcttgaaccagtcaggaccataaggctttgcatcagaatcatcagagtctacatcagcttcactttcactttcactttcattgaaaaaggagtcgtcagattcttggtccaattcagactcagaggaggaagagcttaacaaatcttcttcagacgaagataaaagatcttcttcggatgaagaactggctacatcgtattcgtaattagacgaaaagaaacgggacattttcgtagatctcgggcttggcaggctattgtgtgaagattgcaaatatgtgccttgttctcctttttttccttctatgctactctactaacaagtgcaactgcgaacctgtagctaatttttcattcctttcaaagctctttttctcattgaaaaatttttcaacggcgaaaaaaatgcgaaaaaaaaagcttggtcgtttccaacgagtagaggaaagtgacagtaataataatgattgcgtctctaatatatacgtacttatccattgcatgaaggtaatttgggattaaaatacagttgaaagagttgtcagtgtcatggggattgcatctgcaacgtccgaattggatacggggcatggtagctgagcatcaaagaactcttgaggaccttgacaatctacgaattgatcttgatccagtttgaatgctcgagcaagagtgtcccacgttgagaataccaataagatgtggggattagtttcggcggtaggcagtgatgataactcgggaatagaggtgtctctcgtggttaagggaacatatactgattgtgtataaccctcttttaaaggccccttcataaacaagtctgtgaacgatgacgctatacgagtatagtagccatactgcgagtccaatccggtgaaatcaccgtaagcttcctgaggagatacaattttcctcgttattgtgtcgatggtgacccttgcgtttatcggcaccagctgactttgtagagccagtgctttgcttttccctatattaatatatttggtttgcttgaataccttaccaatctttttgcgagccaaggtgggtttctgcatcttgatagtgaggccttctctgtaccgaccgtgatcttgcttttggtacctggtgaaaggaagtgtggataatcttggtaattttgaagcggcggtcaaataaggtctgaatttttcgttgaagacagtattgcgaagatatggaggcgtgacgaagtattgtaaaagtgccagtattaatttagcagtggagattttttttttggtggcatcgacctgggaattgtcctcaagaatgacaacctcagaaacattaaacagcgatgcaaacttggccacttggtacaccttatgcgtgatttgagagaggttgcgacagtccgataccaatgtcgtggggatacagagtgaataatgtctggtttgtgatagaggtttctcaacctttttgaacttcctcgtgctgctcatcaaactaagtgatacacagctttgtggtcagtagtatatattcctgggaccggtagtagttgtgaaacagagtactctcacttgccgatcacagctcatcgatgggaaatttttcatgtataaaataaagcttgttaaaaaatcagttcgtttcgcgtgataacaaacagtgcatatttatgtaccaagaatccaaaaaataagatatatttagtataggtaaacgttatggaggtgtcatgtttcatggttcttttgtcgtactatcatcttcgtcttcgtcttcgtcctttagcgcttcacgggactttttgttgaaaattgcccttacgtcgtaatgcttctttctcatttcttcaaatttcttatgtctagcctccggtgagtcttcatcattctcgtcgttggtctcaaaatccggttgtttgttctctttgatttcaaattccggttcgcccagggacaaatcgtcgatgtcatcgtttgccacctggcatggttttttatcactattatcctcatcttcatcatcatctactctgtagtattccccgtgagggtccacagcaccttggtagggggtcttgggctcgtctatgtgaatatcttggaactgcttttttgttatttcattttctgctaaatttctttggttccattgaactcgctcttctggtgtcatcttggccaacatgtcttgctcatgtttcagtgacagtgtgtcctttggaaggaaggtactcgatgttccaattatctccccctcctcttttgtattatctagtcccggtatattccttttatgtgatgtcaatttggcatttttctgcgtattttcgtaaacttgtcttctaaactcttcaagcgtttctggatcctgttgcgccagctgctccggcgataaggctagcgggtttttaagtatacctcccattattctgctgatgtgcgttcttgatgatacgaactcgttgtactgatgaagctcttggactttaagttgtagtggtgttctcaaattatcctttcggtggaagtcatttctccctaaaaaagcgtgagggcaaaacttgaaaccgggtaagaatatgcgatagtaccgttttgcctctaaagacagtgcttcagagaaatattagcaaggtgtcgaatcaagttatactagataggaggatttcataatgaataatgctttaaaatggttctcacctttattttatcattttcttcttttcttctgctattgatttggtagtgttcgggttaattcatttttttgttcaataacaagaaccaaacataaaaaaaaatactttaagaataaacaagactgatgaagcatagatcatattattagagcgcgtaaggtatgtagagcacagattggtccttcgagtgtgattatataattttatatacgctccttaatttaaaagcggcttagatagattttttatactttgctgttggaaaattcctgctgaagcaaaagaatttgcaattcgttcttagcctttaaccccaattttaaggctgaagccgtggcttatatcatgggctttgtttatccaacttttcacatctatagtacgctatctttgcatctcttaggcatgaattgataggcgatgagcagaatgaaaaatgaaaaaaaaataaaagtactaaattgaggctagtagaagttaggcaaaaaccgtccagaacctccacaaaaataactaaatacacatttatgggtagtgttcaacgacaagatttggtcctattcagcgaccaatcagtgcttcctgcccactttttccaagacagcaactctcataacttattcttcatcacccatcaatcctgtactcaaccactatggatgataaacgcactagtagaaacgcacgtgttaggttccccaagttcccttaatgaatcttcttcatcgatgctaccttcgtcaactcgctcccatgcagtccttgcgtcgtttatccacgaacagaactattttacaaattcattaaacaagctaaagatcccatctaataactacaatgttttagacttcctgtccgacttcatcgttaataatatccataataagccaagagacaaaatactaagtgacgtactcgcaaagttctccgctgctatacaaaataacccaactgacaccattgttatcatcgaacaaccagaattactgttgtcgctagtaagcggcctaacttgttcagaattaaacaataagttcatcacacctcttttgaggcaatgcaaagtgctaatcattgtttccaattcggacatatttaatatagatgaatacgatgcttctgttcattcctcgaatctgcaaaatttctacaaatcttcctttatcaaatcaatgattaatttgaacttgaatcctctgaagaccggttttgcaaaggacgtaaccggctcattgcacgtttgcaggggcggcgcacccattgcaacttcaaacacaagcctacacgtcgttgaaaatgaatacctatatctgaatgagaaggagtcaacaaaactattttatcgctaaataatgataagattatatacgaggcacattgattctcgtattattgttttttctatgaactgaatatatttttaagtacaatatcaatgaaaaatatatgcaatcgagctctatcaataaaaaaaataagacagaaaaaagtggaaacgatactacctactccgtcttgctcttattatgtcgtctaatttaaattcgactgcacatcttgtcttaattaaagctagtgcgggccatgtacttcgttcaccagattttatccagtatggaatgttgtttagttgaccttcaataatccttgttaatgatagacttttcatccttggtaccacagcaatctccgtagctgatctgggagtcttttcatcaattattagtctttttattaatgagcacaacaggcctaaattatccaatacctccatcctatgtcgaaattccatagtggcaatattttttaattttctttccagatgatacttaaatttaaacgccagcggttccatttcagtaaagttcaactgcggtatgcccaattctgggattatgtactctgctgaatcgttgactgccgaacttgggggcacagggctcattaaaggctctggctcaagatcctcgacagttcctgcctttatgggtgattgcgaagaggatctctgtgtttttcttactgtattcgcgtttataggaggcatatttggataatgcttataatagtaatattttgacgtttttatttcatgcttcaaatcatttaccaccaatggtgccaagtatggtctcgccaaagaaacaatgaagttattaacattgaatagttccgttaacctagtataggggctctccgttatgctcggattgttggcattttctggggtaagaaatttgacttgtttatttttattgatgttaagaaaaggctcaatttcattttctaaatttttacataatagtgatgtatcctctgaaattacaccagaaccaagtgagcattcaatggctgacttgattaatacgtttggggttgtcacataatttagtaaattagggcatgatttatcagttggatgaataacaatattgaaaacttttccagtaatttgataaacttcttcaaaagttttttccttaacaatatatttcataacaaaccggataaaaagataaacgtcttgagaataaccgtggtgtattaggttctgaatcaaagtccccaggtttaggtgctgctctaaattaccgtatccacagctttttaataaatctacatcattcttgatgatattcaagaggttgtcatcggtcaataattgctttagttgctcattggacaagcaaccgaataaacttgcaacgcatgcccccatagagctaccacttataatattaggcatcaggtcctgtaacaataaacctctaatcaccccaaggtgaaacagcccaaacaatgaaccaccttgcaagattaatgctgttgtgcccagtgacaacttacatctttggaaaaaggatgttggagttaaagtttgattatttaatatatccaagccttctagaattcgggtcaaatattgttcaataagtagctttgtacccatcaaagattttgtgaacaactttttatctccaatacccgcaaagttcctcaacatacaagggcctgtagtcgaaaacttctccttaactacatcatacttctcctcccttaacatattttccaatatgctatattgttcaatgacagaattgaagtcgtacctcctcgaaaagaaattccgccgccataaatttgcgcctgttatttcatccactacggacgcttgctgacaccacatttgatacgtatcacactcatctaacttcttaatagcgttataataaatgactcttgagtgtggccgcacatagttaatcagcttttgaacccagaagaaataaatatcggtgatgacatgtagaatttcccacacaaaaggaggtatatggtccaatgtggcatacactacacgcagtatccagtttttcaaaagggtcggtattacagcagacaccttgtattcctgcgccgtttccttcatgcttaacggcaactcaaagatgtgatatatgaatagatgattcccttactattgtgtcatagtacttctctatgtaatcagtactaatttctattagctgctacccagaaaaaaaaaacataagaaaaaaagggttagggttgaattttcagacctaggataagtatctccgaaattactaaaaacctagtatttattaaaatgccctactaaaaaagtaaaaatgacctataaagaacataccctattatagagtggcaaaattaaaaattcaaaagtatcgtcaaagtatggaaaagaaccaagacgccactacatttaggtagacgtggtgatcaattgaagttcaagagaagtgggtaagaatacattgaactaagccttcatatatttacaaaacatgttcaggaacaattacgacggggacacagtcactttttctcctacaggccgtctgttccaagtggaatacgccttggaagctattaaacaagggagcgtcactgtggggttacgttcgaacactcatgctgttttagtagcgttgaaaagaaatgcagacgaattgtcatcataccagaaaaaaatcatcaaatgtgacgagcacatggggctctcgttagccgggttggctccagatgctagagttttaagtaattatttgagacaacagtgtaattactccagcttagtttttaacagaaagcttgccgtcgagagagcaggtcatttgctttgcgataaagcacagaaaaatacacaatcctatgggggcagaccctacggtgttggtttgttgatcatcgggtatgacaagagcggtgctcatcttttagaattccaaccttccggaaatgtcacagaactatatggtacagctattggcgcaagaagccaaggggcaaagacttatctagagagaactttagacacgtttataaaaattgacgggaacccggatgaactaatcaaagctggcgtcgaggctatcagccagtctctaagggacgaatccttgactgtagacaatctttcaatcgccatcgtgggtaaggatacgccttttacaatttacgatggagaagctgttgctaaatacatctaggtctggacacaaagtatcgtttccactaagcaattgtcaaagcaagaccaaagaagcctttcaccacggtcggggtttttttacatataaagataataatagattaacttagtacgtagtctcacttctcattcaaaattaaaaaagacgtggcttccaaatcaactaataaccccgcttaattccgccctccgccggggaataaacggagttatcccctgttgaaaattcagcatgattatgtatcacaatacataggtgttcgtctataaaaagaactacttattctggataaactttcgaactcgctcaaacctatttgtttctgtacatcgaatagacccataatcacttcttggttccaaaaagtaaagtaatagccaaaaatgtccccattgaacgtcggtatagttggtacaggtatttttgccagagatagacatctcccatcctaccaggaatttcctgacaaattcaaagtcattgccgccttcaacagacataaggcaaaagctttggattttgcaaaggttgctgacatacctgaaaataaggtttacgacaatctagatgaaattttgaatgaccctcatgtcgactacattgacgctttgctacctgctcaatttaatgctgatattgtcgagaaggcagttaaagcaggtaagccagttattttggaaaaaccaattgcggccaacttagaccaagcaaaggagattgtcaagatagcagaatccaccccattgcccgttggtgtggctgaaaattggttatatttaccatgtattaaaatcgcaaaggagcagatcgagaaaattggtcctgtagtagcattcacccacaattctaccggtccatttgttactcaaaataaatatttgaccacaacctggagacaaaaaccagagcacattggcggatttctatctgatggtggtgtccaccaattagctctcgttatttccctactcggtgaatttggatctgtttctgcattaacgagacaggtgcgtgaacgttccggtgcagatgatattgtctttgctactgtccagttgaaaaataaagaggttatcggaagttttacttatgggtctgcctttggtgctaccgaaaagtcggttttcttgaaagtctatggtaagaatggtaccgttaccgttgacttatcagacaaaaaagaccccgttgtaaaagtcaaattagggggttcagctgaagataacggtgacgaacaaatttttaaagtcgataatgatgaaagtttcggcgtcaacgctgaatttttgaattttcacgaagctgtcagcaagaaggacaaatccttatacctaggcacacccagaactgcatttcaccatttggcttgtgtggacgcgtttttaaaatcttctgccaagaatggtgactacgttaaaattgagcagccatgattaccgttttacgatgtaacgcttttttaaccttaatagatagattccctcatatatttataactatgtacccacataagtatacttttggaatgataatactaacgagataaaaaaccgttgaaaaatttctaagttttcttgaactaaaaatagccaaaattctccatccacttgttgttgcaaaatgttacgaaggcgaggttcttggaaatctggatgattatgggaaaattcgttcaacaagaacgccgagcctggacgaaatacttagtcggcatggaactagttatgaatgacttttcctatataagatctacaaccgtttccaattcaccatgagatatatatatgtttaacgaatcaggtactcgtccgaagcatttcgagtaatgcaaccccacaagtgtcccccaagaattcactgggatttttgatgaccgaaagaaagctattgcagctgctacggcgtcctttcatctccctttctttattcacggccttaagagcttgtccgcttcgccccaaaagcctaattgcttagagcatgagagttgaaaacgaccagaagtgtcgttttaggtaagcattcggccataatgaacagtaagtttgtccgaaaaatacaccgctagggttcgataacgaagagcgcatatcaattgcgttgtcgacttaattgctctcttagtacaacggtatgtgtcagtgataaaatcctaccggttccactttttgtgagcgatagatgacggaacgtatgcgcctatttcttttttttggcgcagcaagggacaatggtccctttttgagaaaatgttgtaggcttggccatcggcgtgaacgcatataaaaagaagactgccaacatgacagtatttgaaacaactacagatttggcaaagttcgccaagataaagaagaccgaagcaggtgctaagcttccattaaaagtttttcaagaaaaatctgattatgggttcaataagtagataccttcttaagaaagcagcagatgggcttaaagatgagcagagattgaagattgaaatgtccgatagcaaaagtgtcccagagtgctttcattttaatagggaaagaagaatgcccatagccgagataaacggcgaggatgggtttttcatgtttccgtctcagcaatcgcttgaaaattttgaaaacactaaaaagtattcgaatgagctgagtccagatgcaattggtattccattattccaaattatcaattgcactctaccgtttggtaaaagaggtcatagcaatactgtggtcggcaatgtcccatattataaaattttcaaatttattttaagaacggcagacgaacctccgccttatactgtggcaaaaatcgtttgctcaaacaacggattaatattgtataaagtgcctctttacgacatatataaaaatgtcagccaagcaaacgtaacttacagcttcgtagggactacgtctacggagcccaacttactagcaatggctcaccgagaaggacacagggatttggacactaaagtgaataatttaaatctcaggtggcatgtcacttattcgcccgtagttaccaacgatcattataaattaattctgttagcagattatgaagtgaatcgtttggatgaagatgtcattagagccgctaaaaataagatgtccatcgaccaaaaggatcaaaaagttcagaggttcgtggcagctcattatactagagaatttgaaacatctctttttaggtgggtcgctcaagagggccacttaattcttggcgagtattccacagatcaaggatcatttggattgaataatatcccaccattgacggaagaactcgggtgtcagagcctgctcatacattacatagagtacatgaagagacaacgtaaaaaaattgcgaaagaggcaaggagacaaaataaaagaaacgttgcaaacacgactaacatgaacatgaacctcatgtaacaaaagtttgcgtataataaaccagtatagatgtgtaactgtaatttttaacttatcacaagctcgttcccttcctgcgttgaaaaagcgggacaatgccagaatataaaaaaaagaagaaactttaaaccctgtcatatcttgtccgagatctcgtcgttcttgtttaattgatcttcttcgtatactgccaaaggtgccaaggcacaaaaaagtttaaagtggcacgggctattgcgtcacataaagcccgtagcgcaaaaaagtgatagctgacttcattagatcaccaaaatggaaaaaacttcgtgaagatttctttttatcttcctcacagtttttaacttccgggtgttatactctccgtttgaaaagttgattttgttaactttcctctttccttttggagtaaaaacaatatcctcgataggcaagaccttcctgcaccgctatggcggccattttgatttttctttactgtgggaagcaagaacttgttcaggcgccttcctggataagccatcttttttcaaacagtttcttctatacgataggaaagtcgttggccaatcgattaattaattgaacaataggagccaaataagcaggatatcttctttcgtataccgcctgcctcattattcagaacaaacacgagtgatctgacactatgaagttagcagtaatcctttctaagagaggtggcccaaaattcgaataaaattaactttccttaccatttagcctctatcaaaaaggttctaaaaagtaatatcacacagccgagcctaggacgtcacctctttcctacacagttgacattacttatgtactcaaaaggacgtatgtaccaaggaaagcatagtttttattcaaatcgagttttttattcttatatcctgcttaaaagtggtgattaatgaggaaaaaatgacagcaagaatgaaatagtatgtaatttctttagatttagcggtgcccgtgccttccacgcgcaactgttctctctaatttactattcgctttgaacgtaaaatgtgctttagtttcccagatgtagctcaagtattataccatcttttgcacctactttactaaattcatctcaggtataattgtatcgcatattctattttttttgacatttaatgcaaaattgtgtacctttcgttaaggcgaattttctggaccatgcgcagatctgatccaaaataaactttttttcatgaagctcgtttgcgatcattgcctgtgaatttagcgaaggtgtcagtccacggcgacttagaactcacgtaaaaataagcatcttgctaagactgttcagcagtcaacagtaaagttctgaaaacatgttttcttagtctctatctttgcccatgttcctctcaagtggaacaaagctaaaaatgaaatattaattttatataaagtctcactcacacctgtggtaattttgttccctcagatttgtcaatgattctgtcatagaaaaggtatccacaagaaagggtagcgccgtatcaaaatgggttcatctggttcaaaatcgaccacagccactaccacatcgcatagtagcacgactactactagtagcacaaccagtacaactacgcctactaccactagcacgacaagcacgacaagcactaaagttacaactagcccagaaattattgtcagtagttctagcacattagtttcttctgttgtacccgagtttacttctagctcgtcgctctcctctgatacaattgcctcaattctatcatcggagtcattggtttccattttttcttctctttcttacacatcatccgatatttctagtacatcagtcaacgatgtcgaatcatcaacctctggcccctcaaactcatacagtgcgctttcctccacaaatgcacaactgtccagctccactacagagactgactccataagtagtagtgctattcaaacatcttccccgcaaaccagttcatcaaatggaggtggttcctcttcggagccattgggaaagtcctctgtccttgaaactactgcttcatcttctgatacaactgcagtcacatcctccacatttaccacgcttactgacgtttcatcttctccaaagataagttcctcaggatcggctgtcacttcagttggtactacttccgatgcctcaaaggaagtttttagttcaagcacgtccgatgtttcttccctactatcaagtacttccagccccgcaagctctactatttctgaaaccctaccattttcctctacaattttatccatcacttccagcccagtaagttcagaagctccatcggcaacgtctagctcagtgagttcggaagcttcatcgtcaacatctagctcagtgagttcggaagctccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcagaagctccatcgtcaacgtctagctcagtgagttcggaaatttcgtcaacaaaatctagcgtaatgagttcagaagtttcatcggcaacgtctagcctagtgagttcggaagctccatcggcaatttccagcttagcaagttctagactgtttagctctaaaaatacatcagttacttctactttggttgctacagaagcttcgtcagtaacttctagcctaagaccttctagtgagacattagcaagcaattcaatcattgaaagctctttgtcgacgggttacaattcgaccgtttctaccacaacatccgccgcatctagtacacttggatctaaggtttcgtcaagtaattccagaatggccacttccaaaacctcatctacttcctccgacttgagtaagtctagtgtaatattcggcaatagttctaccgttacaacctctccatcagcgtctatcagtttaaccgcatctccacttccatcggtctggtctgatatcacctcttcggaagcttcatcaatttcctctaacctggctagctccagtgcgccatctgacaataattccaccattgcaagtgcctcgctgattgtcaccaaaacaaaaaactcagtcgtttcatcaattgtctctagtataacttcttctgaaactacaaacgaatccaatttggccacatctagtacatcgcttttgagtaataaagctactgcccgttctttatcaacatccaacgctacaagtgcttctaacgttccaacaggcacatttagctccatgagctctcatacttcggtgataactcccggcttttccaccagtagtgcgtcactcgcaattaattcaactgtcgttagctcatcattggcaggttatagtttctcgacacctgaaagctctccaactacttccactttggttacttcagaggctccttcaaccgtttccagtatgaccacaagtgccccatttataaataattctacctctgctagaccttcgccaagtacagctagtttcattactgaatccacttcaagcatttccagcgtgccattagcgagtggcgacgtcacttcctcattagcggcccacaatttaactactttcagtgctccttcaacatccagtgcacaacttgtaagcaaatcaactacctctagctccatcctggtcacacccagaatcgacaggtctggaaattcctcaactgcctctagaattgcaacatcactccctaacaaaactacatttgtttcttccctaagttcaacatccgctcatgccagaaatatctttaattcaactgttctagctactgctaaacaaattgaaactttaacttcaacagtcaattgcagcaaccctactcctaattacaacataaccaaaacagtaatcgtaagtagggagactactgccataggaactgttacaagttgttcgggtggttgcaccaagaatagaaagtcaaccacacttattactataacagatattgatgcttctactgttactacttgcccagaaaaagaagtaacatcgaccacaagtggagatgaggcagaacataccactagcactaaaataagtaatttcgaaacgtccacgttttcggaaagttttaaggatatgaagacttctcaggaaactaaaaaagctaaaccaggatcagaaacggtgaggagctcgtcatcttttgtcgaaaaaacctcaccaacaacaaaggcttctccatcaacttccccatcagaaagtaaagctgcaggaaatacatccgttgcaacgaatgcttcaccatcaacttccccatcagaaagtcaaggtacaggaagcacatctgtagagggagcaaaaagcaagtcaactaaaaattcagaaggagtatcaaccactaaagcgaaaaacacatcaactgttgcgaaatcttcaactgaaagtccgatcgggaggggtgaaactacccttgaaacgataattgtctcgagccaaaagtcgctattaacatcacaactaagttcatccactgaaaaggtaaacagatctaccaccaaacctacggcagcgattcatggaacatcctcatccgctaaacaaagcacaacatatactgtcagcacggcaaaagaaaataccggtgcatccctgaacattaacatgaaagcttttgttattggcgctattgctttggtagcttagtaatatagttattgtccgataccctatgaacgtgcaccttttttgttagtgtattgatatgtgtttcttttcaccttaaaggtgcttagcaaggagaaaaagagaaaaaacaaaagagaactgtacgagttgtaaatatttaaatagtaccttataatcataaaaaaaagtttcaaatgtaacctatatcgattaaaacagcactcctatatacagacccaaaacatggagcagttaaaaagaaaggagctacatttatcaagagcttgacaacctagtctgaaaattctttgtcgtagccgactaaggtaaatctatatctaacgtcacccttttccatcctttcgaaggcttcatggacgccggcttcaccaacaggtaatgtttccacccaaattttgatatctttttcagagactaatttcaagagttggttcaattctttgatggaacctaaagcactgtaagaaatggagacagcctttaagccatatggctttagcgataacatttcgtgttgttctggtatagagattgagacaattctaccaccaaccttcatagcctttggcataatgttgaagtcaatgtcggtaagggaggaagcacagactacaatcaggtcgaaggtgtcaaagtacttttcaccccaatcaccttcttctaatgtagcaatgtagtgatcggcgcccatcttcattgcatcttctctttttctcgaagaacgagaaataacatacgtctctgcccccatggctttggaaatcaatgtacccatactgccgataccaccaagaccaactataccaacttttttacctggaccgcaaccgttacgaaccaatggagagtacacagtcaaaccaccacataatagtggagcagccaaatgtgatggaatattctctgggataggcaccacaaaatgttcatgaactctgacgtagtttgcatagccaccctgcgacacatagccgtcttcataaggctgactgtatgtggtaacaaacttggtgcagtatggttcattatcattcttacaacggtcacattccaagcatgaaaagacttgagcacctacaccaacacgttgaccgactttcaacccactgtttgacttgggccctagcttgacaactttaccaacgatttcatgaccaacgactagcggcatcttcatattgccccaatgaccagctgcacaatgaatatcactaccgcagacaccacatgcttcgatcttaatgtcaatgtcatgatcgtaaaatggttttgggtcatactttgtcttctttgggtttttccaatcttcgtgtgattgaatagcgataccttcaaatttctcaggataagacatgattttggcttttcttgttgttgtgttgaatttcttcctcgaatgtggatgtgaaagtctgtcgcaaatctattaaattagattgaattggccgaatttatacagaagattgacggcacttcacctcgagaactgttggtgcttttttgcctttcacttttctttttctcctatattgtcgtatcgcttccagatgtgaaaaattggcaatgtgatcttcggtcaaggacggaccggacatataagcggagcggggaatctttagtcagcaatggaagttcacacagtagagacacaaattgtgtcacagtatatcacccatttactgtaaaaagataaaaagaccagtaaatgtaacggaaaaccattcattttaacggagccgtgacgagagtggctgtgatcggaattccacgtcaaggtcctggaagacggggatcggggactaaaaaagagcgtcgaaagtatccagtacgtcattaccaagttgaaaatgaaaaaagatcaattagccacattttatcctggatttattatctattatatatcattttaaatggtttaggctcccagagaaaaaagcaaaactcaggtgaggtatatgtacaaactaaataaaagttctaaggtcgatcgctacctccgtatagaaattcctaaaatccctaaggaaaattaactccctcataagtaacatgaggaattcttcccactaatgctaaaatgttcaatgaagctatttttccaacatcataacctctgggaaacgcttttctacgtatgatagaagtatgcgcctacgtgcgtacaaagcggtaacctccactcttctttgacgatcggcccaattatgtgcttgcaacaaaactagcaagaaaaattcttcgataatcatagttggcgtgttagcaatcaattgacctgttgtactccaacgcaaaccggaagcaatacaaattaaaccaatgatgatgatgacggatacaagaacactccatggagttgagcagatcctattaatatattgggatgttctgtaaccaatagtgttaatttcaggagctttaccactaaattcttcgggacattcaatacctaattcttggaataattcaaggtcttctttagccacatcagaataatttttctcttcatgttgaacgattcggaagtacacttctctcaaaacgaaaccgtccaaaaacccaattaaacctgtgtatgtaccgataatcaaccaccaattatcatcccacttcattggcgaaccaataccaatccatgtggcgaacactgccacaccaatcaggacaccaataccagtaccaataatatcagcataccaatcaatcatctttctccctgtcgacctttttttagattcaatagtaacaactgggtgaggtgtttcaaaatcgttaaaatgctttcttatacgatagtcgattttctcgtccatatcaaagatatcaactaaaaacctccccgtgaaataatcatgtctagcccttatattttgtaagaaagtagtgcaaattagaagggaaactgcaactgcagtgttaatatacatctgccaagcgtcactgaactttttcaatcttggattactacctgtagtttctccggtgtaaggtggagtgttgcccgcatcttttgggatagcaccgcaaccaatccaaacgaaaatacctatccaaaatatcaccattgctgcaattgaacccatatacctacttgctacgttagataaacggtcgtaccaattttccacaggcagttctccgttaatggcagatgggtctatatgattttcaacagagctgacttcattagcttcaactgtgcagtctgctttttcttcctctggggtgcttcttgttagatagtttttgaaggaagccaatctcgacttcaatctaccgcagatcaaaatttgttcatgcgtactcatcaactgttgtctcatcaacagtgtgtcccaaacataactttgaatagactgtccgtcctgcataacaacttgccaattgaaaggtgcgttataaacaataccaataaccacccaaattatgaggatgatccaaacaataaaaaaaaccgcctgcgaaccggccactcgtaccaggaaatccagggtcttatctgtgaaacctttgcttaacccggtaaaacctttactcgtgaagattgcccctgtttctgttaaattcacattacaaagttcgtcatcagtactctcatcgctatggctgactactctgaccacatcatcatttttgtaatcgttagaatcaccgaattcttcgtactgtttgcagtcaacagtaggtgctctatgatgaacgtcaggcctagcacctggattcccgagaaactctgcaattttacccataatttgattaacgaatgtttaataataagggtcttattaggtttctatatctaccttttcccttcttatatctgatactgtttgacttatgataaaagaaacttacttacctatcaattaattcatgccgtgtgaagtatatttatataaacaagtatttctaaatgaagagcatcgaatcaagatgtggtagatgctaaactaatgggtgcaattaagaaggcttctaccaagcaagttcaaggccagtagcattatatagtttttttgtctttattttttttttggttttttttttttcgttttgagaaaaatgctgcttcctaaaaagactcagcaaaaatgctcatgacctaatcagtttcgagagcaaccccacgggtaggaaagaaagaggcgccaacgttaaaggaaactgcccatatctaatacataaccgcacaagctccaagctcattcaacacctgtgtgatttacgccccaataaggctcaagattcctcaatattttgtcgttgttcgagccatgaaaacctcaaattactgctacaggaccctagggtctcgctaaaaaaatgactacgcgcgcttatataattactcgaataagacaaaagaaaaaaacccttgcgatatgtcgtagacacgtaaaaatggcccatttagtggtagtcgcaaactagaggggtaaaaataacctgtccagtactgaaagtaatgctagggaaatgcgaatgaccgtacgtacaccttcgtacatgcaggtatttagggggcttattgtttatgaacaatagcactatgccaggtcaaacatatcatgttcgcgcagtctcctcgtgggatatataaagtgaacaaaaagtgcacccggttttcggaacaacgctcttcgcaacaaggcaaaaaagaaaaatgggacaacgtaatcggagaatacccaaaggacattataatccaatcaacgtagtagtacgtatggttagaacagcaagcacagatatttgctcatatgcaaggaaactggtgtgattagaatgccttaaacatgagtccaatgtatgcgaataagatgctacgttgaataagcagatcaaagaacttttggtaggaaaagcttctttttttaaaagcgcacgtttctttttctttgttggaccttccatcaaaatccttaatacgtgcagcgaagcagcaacgcattgacagttcatacaggaaagaggaacaaatattttgagctgcttgtcccaggaatctaggtgcttacgtatcttttattttatttaaatgtatgatcttacccacgataatggtcttagtactttagtttggcaatgatggaaccggaggacaacggacaaaagttagggtatctttactctgtcactgcgtattttttgaaatacactatttttacaaggagttaagcataacaagcacgtgctgcagatgttttcatttagtgagtgaagatctttattcaagtaattcatcttcatccgtataacttcttagtaaagcgacaaggtctgatggccgaatttttttaattttggccatcgtattaaaatgaacactctaaagccgaaatgagaaagatctcgctaatagtaggttaggactcaatggctaggttatatttttgccttcgtgagagtaatttacgtcgagtaatgtcgcctgacatccatatccctttgttattcttcattaaatgtcactacaaattctgtccttactgaagtaaagaatatttgaaaatactacactgatctttaattactgatctacaataacacacagtgttgaaggataattccaagactctcacctgcgactggtcgtgttaggaaaccaaactgaaatatgctaaatttcgagtgaaacctaccggaatcggtacatctccagaggattttaagtgaagatttaacatcgtataacaagcatgcataacttgtcactgggataaagagaaggtactaaattttcgtaggcgacaattttccatctcatagagtactcgaagaaaaacataaacactattaaaaatagctcctagtaaaggctttttggattctaattcaagtttacaaatacctaccaacaacattcttgatattgtaatctgctctgaagtagataccctaacgggattgttaagtcagggagcagcgtaacgacattcacgaaaagctctaaaaatgcgtagatttggaaagccatgtattgtttcacatgaaatttcggccaggcctcacatattacagccttgtaattataagatggtgctgagttgtaaggtaaaaaaacccattgagttattgcaccttcaagagttaatactttacacttttatgaaaatttgccttcacgtaaacttgatccagcaaaacatcaataagttgtcatatatttctcgaaaatatccaagggcacctgcttttatcagctgcgacaatagagccacggagccaacaaaaaaaggctttttagtttgccgcatgtaatgattggcgaataatttttcaaggttatgattgttcttgggaacacagatcacggaatccttttgccaataatacattagatggaatatttggatacaactttcgaatataacgccttttgagctagcaatatcgactgtatgggaatataaaagttaattttaggcaatttaattaatcgtgactggtcggagaaggcgagattgtagctccaccatgtgaggattattggcaaaggtttagatccggtggagatttatcttcttttaccccatcttacttgtgcactctcccaaattcccatctgatgaactgttagttgattcctttagattataaaacatatgatgtttactctgttttttgtcggcgaagtacggaaaagcatttgtgactctaaaaaaacatggcaaggataattaattaacaatacttcttgtgctgtttataaaatgtatttagtgtaacatgctgcttcctagcatatgtataatgttaagaattttccagtttctttaaaaaggcatttacgtgtatttcttgacggctgcagaaatctcttggatgtcttttggacttgttctgcaacaaccaccaatgatacgggcaccgctgctaatgtactgtttaacaaccgtatcccaactgttcagcttatcgctatttggcaaccatatcttcttttcagtatcataaacttcaccactgtttggataagcaagcaaggccatatttggcagtgcttgatgtagagactcaagaatgtcgggtgattggttgaagctgacgcagttgattcctaagaacgagaggttaggatttattttgtcgcccaagtccatcatctatttactacgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgccgttttctttacctttcgaaccattgagctgttagccttctcttcacagaaactgaaggccattagaagcctccccttcaacaattcccttgtcttttgtttcagctatataatgcgtttatagctctaattgtggtcgaataggaagaatttgcgttaacacccgtaactagctttccatcggtaatagagtagtcatcccagggatgaattggcgccaagtacttggctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacagtcaaaaagatatttttcttttctttctttttacctatccttcatgaaaatacctatgctgatactgaatatcttcatttgcagctatgcaatatttcagataccccattttacccaagagtttctttactggtggttggattttttttaagacgagaagattaccagtcctggatgttcatgaatgtgcctattgcgtcatcagcgactccgcgccaagaaaagaaatactcgcatgctcggatttatagaatcgcataatggaaatagcttccttaaaggatggagataaggaaaaaatgacaagaacaaggaagtacttgggagctttctccgacatgttaaatatttgaaactcacgcagctctcctggaaagttgcatctggaaaggtaaggttgttttttgttcagacatcaaaatcggctcttgtagacaatgtcacagatcgccacaagttgaaaaaaaagtttcgatgaactggataaggggagaggtcacaaacaaagtgtagggggtgagtagtatagtggtaacttgttcatttacctaaataacattctcactagaaaagagatattgaaagactcctcgtttacctaacttggctggttcttaggtatataatagaaacatggatctggcaggttattacttacagtttgcattcccaccaggtaacaattttcattatatatagttattttttaccaccacttcttcttctttcactttgtcttgcaatagaaataccaaaacaaggtgaggaaaaaatcgaatctcaacgataaaaatatgtccatcacgaaggtacatgctagaacggtgtatgattctcgcggtaatccgactgttgaggttgaaattacaacagagaatggtctcttcagagcgatcgtcccatctggtgcctccaccggcattcacgaagctgttgaacttagagacgggaacaagtccgaatggatgggaaaaggggtgaccaaggcagtcagtaacgtcaatagtatcatagggcctgctttaatcaagtccgaattatgtgtaaccaatcagaagggcatagacgagctcatgatatcgttagacggaacttctaacaagtcaaggttgggcgccaatgctatccttggtgtttccttgtgcgttgctcgagctgctgccgcacaaaagggaattactctctacaagtatatagccgagttagcggatgctagacaggacccctttgttattcctgttccttttttcaatgttttgaatggtggagcccacgccggtggctctttagctatgcaagaattcaagatcgcgccagtcggggctcagagctttgcagaagccatgaggatgggttcggaggtttaccatcatttgaagatattggcgaaggagcaatatggaccttccgctggaaatgttggtgacgagggtggagtnnnnnnnnnncgcccccgatatcgacactgccgaggacgccttggacatgattgtgaaagccattaacatatgcggttacgagggtagagtgaaagtaggaatcgatagtgctccttctgttttttataaggacgggaaatacgacctaaatttcaaggaaccgaactctgacccatctcactggctcagtccagctcagttagcagaatattatcattcattgctaaagaaatacccaatcatttccctggaagacccctacgccgaagatgattggtcctcgtggtctgccttcctaaagactgtcaatgttcagataannnnnnnnnnttgcagatgacctgacatgcaccaacaagaccaggatcgcccgtgctatagaggagaaatgtgcgaatactctgttgctgaaactcaaccagatcggtactctgactgagtctattgaagccgccaatcaggctttcgatgctggatggggtgtaatgatatcacatagatcaggtgaaaccgaagatccgtttatcgctgatttggtcgttggtttaagatgtggtcaaattaaatcgggcgctttgtcgagatcagaaagactggccaagtataatgaacttttgcgtatcgaagaggaactgggggacgattgtatatatgctggtcataggtttcatgatggaaacaaactataaaggattgtcttgtttcctttttttttttgtttttttatgactaaataaagtaaatcatatgaggttttattttttatttcgttgatttgggttacagtatggaaatggggcatttgacacaagttattttattcatatgttttatcttgtaggaaatcaaaccgtttttaaacttttccattgcctacacacaaaatcattacgaatctgtctgaacaagggtggacgtgtgggggaaggctgttccaatcaagaaatgcttacaactctactaacactgcagtttttcagctttctgattaatctcttcggtttaaattttttagcagctattactttctagtaacccttataacgcggttggtatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcgtttaaaaacaagaacatcttcatagtgatcatgaaattgtgtgaaagatgagatatgtaatgcgtgaggtactaaatgaggatatgttaacgaatcgtttaagtggtgatgaccaatgaaggaataggtataaatagagatacttcaactatatgcctttgagaatatgtctttattccttcccttcctgttaagcttatatcagcactaacaaacaaaacaaatacaatggtcaaattaacttcaatcgctgccggtgttgccgccatcgctgccggtgttgccgctgctccagccactaccactctatctccatctgacgaaagagtcaacttggtcgaattgggtgtttacgtctccgatatcagagctcatttggctcaatactacttgtttcaagcagctcatccaactgagacctacccagttgagattgctgaagctgttttcaactatggtgacttcaccaccatgttgactggtattccagctgaacaagtcaccagagtcatcactggtgtcccatggtactccactagattgagaccagctatttccagtgctctatctaaggacggtatctacactgctattccaaaatagagagaagcttttacgaacgaaattccatagacaataaaaaagtaaagagaatgaaataaaatatgttattctattgatataaatacaattcctcatatgtaaatgtatattaatatgacaactcatttttgatcaataacagtgtttgtggagcattttctgaatacaataaacccaaaacagaaacttcccttttgtatcactgttctggaaaaggggtgggcggtaataaagctaatagggtgtgtccataagtaatactgaacttggaaatgtgcggctttgcagcattttgtctttctataaaaatgtgtcgttcctttttttcattttttggcgcgtcgcctcggggtcgtatagaatatgcgtcacttttaaaaataagattgcagatcagggcaaaacaagtagcaaatcatagcaagagaccctgatttttgtgacataaatatttttacttctgtgttaggttaactttttatgtaactgtaaatggaatagagttgaggggatagtgcccacaagtcaatatgtttattttgtaaagttgaaagataattatttttatgtttaggtgattttggtgttgaattttctgtaatattaacataagagtaatacattgagtggttagtatatggtgtaaaagtggtataacgcatgtattaagagcagttatacaatatttggggccgctgaatgagatatagatattaaaatgtggataatcatgggctttatgggtaaatggaacagggtatagaccactgaggcaagtgccgtgcataatgatatgagtgcatctagtactgatttagtgagagatgggccgtggagtggaatgtgagagtagggtaagttgagagtggtatatacttgtagcatccgtgtgcgtatgccatatcagtatacaagtgaaggtgagtatggcaagtggtggtgggattggtataaagtggtagggtaagtatgtgtgtattatttacgatcatttgttaacgtttcaatatggtaggtagaagaacagtatggtgagtagcagatggtggatggtagaggaatagcagggtaagtggtagtggagttggatatgggtaattggagggtaacggttatggtgcacgatgggttggtggtagcaagtagagagatggatggtggttggagcggtatggttgaaggggacagggtaacgagtggggaggtagcgtaatggagggtaagttaagagacatgctaaatcagggtaagaatagggtagggttagggtagggttagggtagtgttagggtgtgggtgtggtgtgtgtgtgtcccacacaccacacccacacaccacaccacaccacacccacacaccacacaccaccctatctaacctgtctccaaacctaccctcacattaccctacctccccactcgttaccctgccccactcaaccataccactcccaaccaccatccatctctctacttactaccaccatccaccgcccatcataaccgttaccctccaattacccatatccaactccaccacttaccctgccattaccctaccatcccccatctgctactcactatactgttgttcacccaccatattgaaacgttaacaaatgatcgtaaataatacacacatacttaccctaccactctaatcccactaccacatgccatacccaccctcacttgtatactgatatggcatacgcacacggatgctacagtatataccactctcaagttaccctactctcacactccgctccatggcccatctctcactaaatcagtactaaatgcactcgcatcattatgcacggcacttgcctcagcggtctataccctgtgccatttacgcataacgcccatcattatccacattttaatatctatatctcattcggcggccccaaatattgtataactgctcttaatacatacgttataccacttttacaccatatactaaccactcaatttatacacacttatgtcaatataaccacaaaatcaccaccaaaatcacctaaacataaaaatattctatctttcaacaataatacataaacacactcaattgcgtatcaataccaccatgatgtcattaacgtaaaagttccttaatattaccattgcttgaacggatgccacttcaaaatatttcgtacttatacagaccttacattagaataatatgcacctcactattgtaacactctttattcactaagttataatatagtagtggctcacattcatgcgggtgctatgatacaatggcatcctattaccattcccatatgctaaccgcaatatcctaaaaggataaatgatgcatctttaatattgtatgtgacactactcatacgaagagactatatctgagcaagacgatacagtgatatgtacgttgtttttgtagaattataacgaaacgtcaaataacccttctatattataacttatcatcggcgtatactaaaacggatgttacgatattgacttgttgacgtaatgaattacgatctagcttatatgtcataatgtagtaagtttattggactcttctatacgttatgtaaatgtaagaattacatagttaccgttttgtacatagaaactatagtttcttaagtactaccggattagaggtttgctactatatgttttctttatctaaaacattactgaaacaactctgaaacaatactaaagcattactcatatcatgctatattgggttaccacattcaacaaaattaaccaaaatagggcaggcagtaaaaagttctaatgatttttctatttgatcaagataaaataaccttctgctgaggaccgcacattgacgtatatacactgcttttagttttgtagatacaagatatttgttaaaagaaattgaaattaggagtatttatctacagctgatgcaatttcggcgatatctttaggagacgttctacaacaaccgccaataatgcgcgcaccattatcaacgaatttcttaaccatggtctcccagtcatccaacttattagtcggccggtgccatgtcttctctttgggattgtagatttctccactgtttgggtaaactagcagaggcatgccaggtagatgctcgtgcaacattttaagaattaatgccgattgattgaaactgacacagttaactcccattaataagagattcttgttaattttatttccgaggccttttatatggacagaaatttcttccaaagtggtaccgtctcgtagcaaactattgtcatccaccgacaacccaatataaaagggcttcgaaataatatcttcatcccaggataaaatagcctttaactcatgaaaatttggaatcgtttcaaaaccaataagatcaatatctctattttggttgaagttctccagctggggtttgaaaaagccgtagtaatcaatattctcaggatggggaccatagtcaccagtatattcacaggatacatgtgctgcccatgggccaatactcccgattaagtaccttttctcaccaataaattcacgagtaaatgacacgattttgtcgagaaaacgcttgtaagcagccagagttttaatcgaggtattctcagatatgctttgaaagtttgcctggtaagtaattgtcattaatatgtttgcgccagcaatcataaagtctctgtacatttcttctaccacctttcgctcttgagaagatggctcccaaaaggattcgctcgtaaaaggagctgcagaccataccggactatttatgttaatgcctctgttttccaattctgtaccctgtccaccatcaaggataagaacttttccggggtgctcaactattagttctttgattggaatgcgcttcatctgttttttgattactttttcaagttgcacactaaaagttgctgattcagatttcttctacaacttgtctgtttaaattatcttccttagtagtacattttcaaattggcgttgttgctgttttgctattaccattgaatacctcgccacaatttggtagtactttcatgccacagtttttacttttccacagttcctgcaggaatggctttttttcattaactttttgcggggatagcgaagagatgccaggaaataaatgcgtatatattttacagatttgggtggttaagtaatcaccgtcaagagttctccatcaggataccatgaaagatacccgaaatggatgaatttgaatctaccaaactttcgaaggttcagttttccactagcgtgttaagtacgccttcgaatgaaggaaataatctaatacacagattcaagaactctttcaagcgaaatgattcaccagcgatccaagaaggtttgctgtattcggagctttcagaggaagaaaaaatacaatgggacttagccaaccagccgtataaaaaggtcctagatcaaagacacctgaccatgatagccattggaggtactctagggacgggtcttttcattggtttaggggaatcactagcgtccggacctgcttctttgctaattggtttcttgttggtcggcgcatctatgctctgtgttgttcagtgtggggccgaactttcatgtcagtaccctgtttccggctcctatgcgctgcacgccagtagatttatagacccatcagtcggcttcagtataggaattaactacttattgatgtggctcatatcttaccctagcgagttggtaggatgttcgcttaccatctcttattaggcaccatcggtcaatcctgctgcctgggttgcaatcgcgttcgttttaagcatgctattgaatctttttggggcaagaggctttgcagaatcagagttttatatgtcaattttcaaaattgtggctctattcatttttataattattggtattgttctcattgcaggtggtgggcctgattctactggatacatcggcacgaagtactggcacgatccaggctccttcgctgttcctgttttcaaaaacctctgcaatacttttgtttcggcagcatactcctttagtggtacagaaatggttgttttaaccagcactgaagcaaggagtgtttcctcagtctctcgggcagcgaaaggtacgttctggagaattatcatcttttatattgttacagtgattataattggttgcctggtcccttataatgatcctcgtctgattagcggttcatccagtgaggatattactgcttccccgtttgttattgccttgagcaatactggtgctatgggaacaagagtgtctcattttatgaatgcggtcatcttgatagccgtattttctgtttgcaattcctgcgtttatgcatcctctagattgattcagggtttggcgacagcaggccaacttccaaagatctgcgcttacatggacaggaatggtcggcctttagttggcatggctatatgtggcgcatttggattgttaggctttttggttgtttccaagaaccagggtacggttttcacatggttgtttgcgttgtgttccatttcatttttcacaacttggttctgtatttgcttctgtcaagtcagatttaggatggcaatgaaagctcaaggaaggtcaaaggatgacattatctatagatcgacattagggatatacggaggaattttcggctgtatcttaaatgttctgttggtaattggagaaatatatgtatcggctgcacccgtgggtagtcccagttctgctgctaatttctttgaatattgtatgagtattcccataatgattgctgtatatattggccatagaatttaccgcagagactggagacactggtacatcaagcggatggatattgaccttgatagcggacattccttagaggacttcgaagccaccaagcttgagagggatgaggataagaaatacgtttcctctaagccactttactataggatctatcggtttttctgttaacttagtgaagtacttcatttgaatattaattaataataattttatgagccgggaattttgcatctatattctaggtttctggcaaccgtagttttacgtaagatgtattttgttttgaatattctgttttagaatgatattctaggccctgtatattctccaataacagtggcacgtccagattctgtgacaatgctaatatttccttttttttttttttaactttagtatccgcttattggaatcagtgatttcatctaagtttactaacgcttacacaattgtggaagaaaaggatagaaacaccttagatccccttgttacggtaaaccccctattctatgcctcagtaataactagaaatagccgattatcattatgttaagtctgtccatacctattatagttcaaaaaaaggcggacatcgtggttgatatttgtttgaagccttgaattttattgtattacatgtataaatagctaacaacgtttgttcagttggtaccaatcaccttttttgctgagtatctgcacacattaacaagacaatggaaaagggagaaaactaacaatcttaaacgataaaaccagacgaaataacagctgttatttttcatgctagaactaatggcatgatagtatacttgtaccttgcatcttagtgcttgaacggatgattcccgtcgccccgcacctatgcatacaagacgtgaatcttcctgtgattatattttgagtatagcgtagtaatcccatatttctcgttgggtggtgctgatatttgaaaattcatgacctgttctacatacggctgccattggtaggaccgcaatcacagtgtaattttgaagaacttgggccaatggatgagctgtgaccataattcattagttgtttgtgtcgcaagctcagaattagaagttctctattgcaaacattatttcatgtttccttaaattttttttattgtaccaactttagtgaccccttgtgagctccaacatatttgaaatcttcttaaatttctagtcggcaagcagcaaagaatttcagtagtaatctctaccgcggcaatatcgatgcaaatgtaactacctgtaaggatattgtcttcagtggtttggtatggttttgtaccttactcaacatcacgaataaaaaggaaggaatacgaatcatgatattgatgtttaatctttcaccgtcaaacaattaacatatatagtatctatattcttttatagaatactgcttgagctgttttttacttgaaagaatggcgccgcgaagaacccctaaattttgtagccctaatttcgatcagttatatatagcaatggcaccctcttgaatagcttcatgattggatctttttatatagtttccacgtaccacgcaaaacttgtctcaagtagccactttacgaggattttgaacggatttctagcagtttcttcacgctggggcgctgttgcattctcttataccaagctcgaagcgcctcgcactcttccggcacttgtagttttacaatcgcagcaaatattagaccagctattactgtgatgtcagccattgagaatgaatcaccagcaacatatgggcgttctctgagaacggtatcaaaataatgcattccatgtagggctttgtcgcgctggcgaagtccccactctttgttttggtagagctcgacttcaggccccaatccaggtgtagcatggtgaaaataaacactaacagggtcgagcagttctaactctgcgcgtttgttcatcatgtggattacgcctttttccagcggtgttttgccggtaagagtgggtgtaccatcaagtgcatcaatgtattcagtaatggctgtgcattcagcgattaaagtcccgtcatcaagttcaagcactggcactgtgcctgaatagttcttggcaagaaattcaggcttcttgtgctctcccttccagaggttgatcctgacaaattgcacacttgatagcatgttcttctcagccaaggcaatgcggactcgggccggataaggccctgcgggtgtgtcatatattatcattttttgtttcatcttttcacctccattgtaaatcaggaaacctccgccattaatgtatcctttgtaggtactttatatagagcgccaagtttctatcctttagcaggaagcacattattaatcatttgagacgtaaacgaatgaattagtaagcagtgaaagaaattcgagtattaagcgcgacctaagggaacggacacggaacggagaaactgaagtatcaaatacttccacttgatcaagccacttgtatccactccctgctttgcacacggtagtagaaggtctcttggatatctactgtaaataccgatttctatgtccttcttgtccgattataggattcgggtcatttccagcgcctactttccttcttgatttcaaaatgtgtggttaacgtactcccaattgcactgctgttcctacagttcacgcgcacctctttctgatgaaaatgcagctgcattaatctgcgatctattggcatctcgctcttgtatctgccctccattcgtgaaattttactctattaccatctttgatcatttttttgtcgcaaatgtgatacggcatccatcgaattttgctcgtaattgtttgccattatcgtccttttcattccgtattattcatccaatccgcttcataataagttccgaaaaaagaactattgtacgagcttttagactcacgaaaacattacttaaacaataattagcgcctacagaacttgacataataaaattccattttcgatatctagctgtctgaagatatgatatctaaataatacgggaaagtttccgctattattctccgttgcaagctcacgtgaaaatgtggattcgcgagtgggttgtaagtgaggattgccaagccttttgttcgaaaacttctgcaggaagcgttgtgttgcaaggatgatgcagcatgaaatatgtgttttctttttttgaggttcactcccacaggtgattccttcgagaaattctgcaacccattgtgatatgatgcctggccgaaagatttcttcggagcaggttcggcccgaaatcctcatgatcgagccgaatgccaagaagtaaaacaccaggatgactaaccagtaattatcatgtgtatacagtactttggtacctttatcaagaagtatactaaaatataccaacaccacacacatgcacatggtagctgagcgaacagtttcgagatttcagcattaatttcatctaataggactttccgtctgctttcaagatcaacgtgcagaacatttttactctgctttcataatactcccattttaggctttgattcaaaagcccactcaatgcaatacctaaaatgatatccttcaaagatatatttaatgaatatgcagccacagctttgaattcagattgaccttgtgttgcattaagtcagacacctctggatttgtgtggctgctctcaagaaaggatgttgaagaagatttatttacggaagaaataactgtatacggcattttattctttcttaaacgagcaaattaaagaatagacggatagagactggagctttagcatgtgttccgagaagtccttgacacgcgccacggttgttatgccgcacactacaatgatgtgtttgaaaaagtatattaatgcctattgtcaagatgcaattcatcaattccagcattgagtgattcttctctggtgcggtaaagcataaaattttaaatctagtactcaaccaccactgaacaactattaatcatcgtggaaattatcatgacggaaattgaatttgggcaaccccttcccagcaatctagactatgctgtttcttttggcattcctacatgggattcggcaataggctatgcggaaaaggtgccagaggtaataggcaaaatggctacaggatatccgaggtactttcctcaaccccccgtccagaggctttgtgcttactttgttaagaaatttgggcgaggttcagaaaactgtcgtccttttccatccgttaacctgggtttaaactgtttggagtacgtaaaatctgtcaaaggacctgaaagtgaagctcaccttgaagtggaaacagttacgattaaaaaccgtggggcaaaaacgtcgaaagaaccggcggaattggtgctaaccattgctgctgtccttgcatcggaggaagagttcgagattgtgaaagagtattggaaattaagaggtgaatgtgtatctagtcgattggcgttgtctgtcaaccaactccttgactgcgctaatcatggctcagagcaggtattgcgtgagctagaggctggtgtttttgcagcaaagaagggggaggagaaagcaaagaacctgataaagggaaggatagttgagaatcgcttcaagccctttggtttggagaagaaaaccccgaattgggagggactcaacctcaacccaaatgaagacgtgtatcttgtatcaagtggcatgtctgcaatatccacggctcgtaatttactcaccttttgggaggagaaaaagaatttaggagattcattaaacaagaccacctctgaccaaaagaaaaagccattattatgtgacaccgttggcatcttcggcttccctttcaaagatacgcaggtcattatgactaaatttggaaaatgtaaattttttggatttggaaattctagagacgttgtcgaattacaaaagtttttagaaacaagcaaacaacgcattcttgccgttttcgtcgagacaccttcaaatcctctgctgaatatgccggatttgaaaaaattgaggagattggccgaccagtatggcttttttattgtaattgatgatactattgggggccttaacgttgacatcttgccctatgctgatatagtcagtacgtccctgactaagcttttcaatggtgctagtaatgtaatgggcggctctgtcgttttaaatccgaaatcatctctgtatccatatgctcgtgagtacttcaggagcgctaatttcgaggatttgttatggtgtgaagatgcgatagttttagaacgtaattccagggattttgaagatagaactttacgtgctaatgcaaacacagaaaaattgttgaatgatttgcttttacccgaggaggagaaaatatgcaaaaagatttactatccaactgttacttctaaggagacctttgagaactacgaaagtgtacgtaatgaacgtggtggctatggatgcttgttctctgtagcctttttcaatgagggcgatgcaaaagcattctatgactctttaaaggtattcaagggaccttctaatggtactaactttaccttagcatgtccatatgtccatctagcgcaccactcagaattagaagaagtttccaagtttggggccgaccccaacattattagagtaagcgtaggtttagaagatatccagtggttattgaaagttttttcaagtgctttagatgttgtgaaaagcagaggctccaaacactcatgaagcagatcatgagtagaatatcaaaaatcaagaattttttataatctttatagaatattgtttataaaagttgttttccattctagcattttttttttttggaggaagtcttttttggaaccttcacatggatcttaattaatgaaagtagatagagctcataagatcactagttgtttataaactgaagatgttctttcttgttgacttcaacattatatcgctctgaattagttgatctgtaactttagagtttctttaccagaataaaagcgtcacagtttttctttagtttatatgtacacaggttggggtttactataaactataaaaaagaagtgttatcgccgctattttaaggtttatacacaattttaaccaaaaaaaagaataagttgagcaacgttggaactgcctctgcaacgaattccggctatatacaacctgcatctttgaaattcaaatatccaaagttaatgaagaaggataataattttcatcattcaaaaactttagatctgccacgggcctttccgcttgtggagtaatcctgaacgcatgtctgtgaattggttcttcccaatcaatcactgctgaatgttgaactctgcggttatcccaaatgacgacggaatggggttcccatttggctcttaactgtaaatcatggctgctctccactagattgtacaagaaattcaaaagtgattcagattcttgtcttttcaattcgactattttcctagaaaatgcacgattgacatacaagcatttctttttcaagacaggatgaactctgaccagtggatgaatatgcgtgacaggtgctcttctttttatgccgccctggcgctgtgaattctctgcctgttcctttgaactatggatgacatgaagggtgctcaagaaatcttgcaaaggcttcgacaacctgtcgaaagcctcgatcgtatccgcaaataacgtatctccaccaccatcaggaccttcaacaacactaaagaaagtataagaaggtggctgtaactcgtaagagacgtctgtgtgccagccaccagatgatgtggagtcatcaaaaactcttgcaaattcttccgcatcaggtcttcggaaagtgatatgcagctcaggattgttttgagggtggccactagtttgatgaatgtgcaacttgccaaaatgtcttccgtattcagtcacataatcgggtccctcgtcagcaaaattctgatttctaaagacaactactcccttttgggcgacaagcaaagcgagttcatcttttgcagcatcagaaagatcagttagctggatcccattgatctcgagacctaatttcggggtgatcttcttcacctttagttgaccaacgttttcttttgcaaaaaggtttgaaaagttaccgtcagctctcaaagcaggatcatggtattcgtgaaattccagcgggccatacttttcagtaggatcccatgtaggcaaataatctggatacttcgatttctctctataagatttacggattttcaataaaccagatggagagacctcatcttggccatcataaaaatgggtatcaaaattcccgtaaccttgcttggaggtataattcaggtttttcaacccatttgtaatgattttgactggtaaatcggtagatggaagagggattgctgtttgagctgctgcaggagacatattttaactgggttactgtgctatgtttgtacaagtatgaaagggccgattatacagcaatagtacacctttttatatgtttctgtcatcaagaactgctactgactccttaacttttccagcattcttgttgtattgcctacataccttctttatgttagtagtatgataaataaactccatgtaccctgtggcgccaaataagaaatcgactcaagccacattgaggcttttgtcatcatttccctatatactaatatagcacctttccaagggccaagagccaagagctcgtccaatgagacgcatgagttgggtattttaagctgcacagtagactatatagataaagctaactagtatgtaaaaaacgttacatgctatggcgctcttagaaaaaacgcataatataagcttcaagtcagtttaagctatagttcgcacggatatcttcaagaagaccgatttgttgtggctgccatcccagctcttttctggtaccttcgcttgaaactgggccatctctagtgacaaaacaggtgaggaagccaaaatgactttccgcgtcatcaacagggatagaggccacgggaacattcaaaatttctccaatcacacgcgcaatatctttgaatggtataccttgttcaccaacgcaatgatacacttgtcctgtttttcctttctctaaaacaagtctgaacagaggagccgtatccaaacgatgtacagccgcccaagcgtttgtgccttgtccgacatagccagattttccggcagctttggcaatattcattaatattggtacaaaagccttgtcccccttgccatgaaccgagaatgggagtctgacaattcttgctgaaacacctttgtctttgtaactcaaggcaacctgttcagtgacagcacgcaaaattttggaatcttcattaataccatcctgttcgttagcaactttgtttggtcgcaaagaaagtgtaccattcgtatataagaaaggcttgttagaacctttaagtgactctagcatagctacagtggcctgacggtcaatttcgcagcactgttcaaaatttttaaaatcatgcacaaatcctaaatgaataacgccatcagattcagtggcaccttttttcaaaatttccagatccttgagatcaccgcgaaggatttttgcagcaggatcaatcgacttaatctttgcagcagcctcgtctgaccttgccaagccaacaacttcatgacccgaggatattagttcagataatacggcagaaccaatgaagccagaagctccagttacaaatactttcatttttttgatctcttttttattttcttttgtaaaagttgagttattacgccttagcgcttatgaatacaagagtgattgtaagcatagttgatagaagcgggagccgttatttatacgttagttgagtacttgagggtcttcatcgcctactttttttccttaatatccttgtgttagtaatcatatcttcaggaaagccaagaactaatggcaaattaaatccgcggctttccctttaaactttttccagcacaatctattatgttgagaagttccgctaatttccgcattggaaaaagaatctcatctgcaaaaacgatggtttctttcttccacggaagacttatgtccgtcctctctattttcatattcttctttctctctctttttgcataacgtcacaataccctagtgctaccgtcattggcgcagcataagagtattgcatttcatgtcttcagattttgcctcgcgaaagaaaaaacactaagaggtgaaaaacaataaaattatgttccactgtgtcatacgtgaggttttatcacggggccaccgttctcattagttacttggttgtaaatgctttgcgttgtgataaatatatggcatgaaaaatcatatgacttcaaaaatgaacagattccagatgccaagcccgctttccttcggctaactagatgcgcgctcgcccttgaaatccttaatcagcacaactcaattgtatggacgtgagctctgacttttgcttccgacaattaggcctttcatatctgtccttctcagatgttatgtatcatgcattttgtatacactatgcaacacccttcgcaatagcgaaagcggaaagtcatggcatcatcaatcgtgctctgaccagtatgtaaaaaatttcttaagcctcaccatgttacagattggccagagcatctggatattcaccacacctgattgggaagactcatagttttatgaaagatttcttcagaaaaaatgacatgctgattttgtctacttgcgtgtgctttcagttctttaccagtacgatttggtcacgtgacacgcgatcaactacattcaatccatctgccccttgctggttccgagtatcaattctaaattgtggctaccactatagcaatagtacgccaagctcggatgcaaatcacggatatcttcttagcatccgagttcaacatccgagttcagcatccgagctttgcggcgaaaacttaacaagataacggataatcaaagttctctgtgatgttacggagtctttggtctgcgctgctgactaaaatagtgtgacacaacgtacatagcgccacccatattggccgataaggaccagacttgtggcgatgactgttaactctccgcgaatctttttcgaagtcgcaggtggcattgcagaaacaaaaatgtgtggcttctgaaaaaaaaaataggcaccccatttgatgtaagacatctggctaccccttgtacatttcagtcactgagcatcgaaggcacgtctttgcagcatgcaatagtgttcgaagttcttccatttacggtggctcccctcactggaacggtgatgtaatatgtagatagctaaaacatttcgcaggtccctaggaactggacgtcaagatgaataggtattgttaaaaatgcgtacctgttgaattgaagaggtcggaaaaatcaaagtacttaaacagacgattgattcgacatttagctattcaggttgcacttcttgaaggttgaacaaaacatcaagagaaaataaaaaagaaaatataacaaaaaagaaatgtcaaaagttgacgtaaaaattggagcagactcgatctcctcttctgatgaaatcctagttccttcgagactcgctgatgttacgctagcattcatggaggagaatgacgcagcagttccagaaatcacgcctgaacaagaaaaaaaattaaagagaaagctttttctcacaatattcacctttgtctctgccattaaccttttactttacatggacaaagccactttatcctatgattcgattctaggcttctttgaagatacaggtcttacccaaaatacttacaatactgtaaatacgctgttttacgttggttttgcaatcggccaatttcctggacaatacttggctcaaaagttaccacttgggaaattcttgggtgggttgttggccacatggactatacttattttcctaagttgtaccgcatacaacttttccggtgtcgttgcgttgagatttttcttggggctaacagagagtgttgttatcccgatattaattaccactatgggtatgttcttcgatgcttcagaaagagctgctgctcagccatttttctttgcagcatgtatggggtctccaattccaactgggtttattgcttatggtgttcttcatataacaaatcccagcatttcgttatggaaaatattcactatcatcattggtggtttgacttttatcatgacggttgttgtaattctgtggtttcctaataatcctgctgatgtgaaattcttttcaatacaagaaagggtatggattatcaggagagttcaggcatccacaggctcttccattgaacaaaaagtcttcaaaaagagtcaattcagagaggcaatgaaagattatataacctggttatttggattgttttttcttcttcaacagttagccaacaatctgccctatcaacagaacctgctatttgaaggaatgggtggagttgatgctctaggttcgacattggtatcagttgccggtgctggtttcgccgtcgtttgtgccttcatcgctacgttgatgttagcaaaatggaaaaatatttcagctttaacagccatcttttggactttaccagcattggtgggatccatcgctgcagctgctttaccatgggacaataagattggtatcttagcaaatatctgtatggcaggacaaatatttggtattccttttattatagctcttagctgggcaagttcaagtgcatctgggtacaccaaaaaactcacaagaagttcggtgtccttatttgcgatgggaattgctaatatcatatcaccacaaatatggagagagaaggactctcctcgctttttacctgcctggattgttcaaatcgttttatcattctctcttgcaccagccattttgttactgatccatttcatactaaaaagaaggaataatcaaagactaaaaaattatgacgaaaatttacaaaattatttggacagaattcaactcattgaaagcgaaaatccttcttccattgaagaagggaaagtggtaacccacgagaacaatttggcagtctttgatttgactgatttagaaaacgaaacttttatatatcctttgtaaatattgatgttttgttgtgtaaatgttctatctgacacttaataattagaaaattaattttttaaactttccggctgcaagaaagaggaactgtgtctctttgaaaggcacaatttcccaaagaatcatttacaatggtaaatagcttactgcttagaaaataatagataattgaataaatttatagaggaatttcttgacaatttcttcaaaacagccggtaaaagtccattaaagattagtttttcttaaataaatcacctaaactttcaaatttagcataaaaaacatgtagatatttgttctctgtactttataatctaacattttataagacagagactagtaacccctctagcctgtggttaaaatacgcaaaacctttgaaccctcaatatttttgccataataatgacaactatattgtacccatttgttcttgagttgtccgtatggatggaaagcagcactcgagtttgctgaaattacatacctcggtatgcaatatgcccagaaaatttgtaaatgataatttacataacaattcaaaacatattgatgtttttcgtgggtaaccatagttcttggaatgtcaactgagggtatttgcacttcaaaaaaaaaaatttattaaatgagactatatacagtgagcacaacctgtctaatacaacggcaaaaattatatacattggtagattttcaaaattgaactctttgtgctaaagaattgtcacaacagtttaaaaaatagtttgaattcttcaaattgaccccatattaataagacctgatgcgattccggtctcacccagattagagagggaatttaattttcttaggaccgtagctaccaaaaatctttgtgtggtattgattatatgatcgtgcttgcgaaaaaaatagaagactaaaagtagcattagtttactaactttctcctcgtatctttcaaatttgtattcccctcaaaagttactcaggttagggaaaattccaagtagcttatcaagatcaattgccattagttgattcaaggcttcattgtcataattcatgaggtcaatttcactctgtaaagattcgtcaacatcttcagtgaagtttctggaaaattcttgtgcggaaatgagtttttctaattcttccaaaatctccaaatcaagacttcccaagaattgtggattgtttaattttgatgtgaacgaaaaggacttatcccttcccataccccattttaaaccgacaatcctatggattcttgaatatctttcatccataacggcgtcactcttccagtagtcggatataaacgcagacagcgcgtcagtatccaccaaataaatgatatacctgaaaatagagacagaaatgaacgaaccgagataactcttttccagtttcgagataacaatttctacaagtaatttcatatgatatgacatcaacttgatcattttttcaatgactcgactaagtcttccgtttctatcattcaacattcccatggctgcagaggatctgtcgcatgtatccttcttataaaataatctcacgagcaaggtggcctggaatatgagtaatcgatgtatcgaaaagcgaacaactttctgagtggcaaacccaaaaggttcccgtaaatgcagaagagatccattaaagtattccgagattaattttagcaacgttaaataatcttgtatagcggtaaaagtaaagcggtgataatatgttttgtactccaaagcgtttttgaaacattgattttcaaaatgcaaagataagctatcatagatgttcattgtacaagtgtagctaatcacattagctatgaatgtttcattttcctcaaaagtgctaaagtcaaaagattcttcatttgctaaggaagagggaacattgatatgtaagctcttcatccttggttctccaagagaacttaaaatgagagggaatttctgatttaaaaaatcttttgtcttgtcgatgttatccaatacttccttcaagtaggaagggccatttattggaaaacaagaagtcagtaatacctgtaaagataaatgtaaatgatagatattctctgctgtagccatcaacgataagtctagattattagtagaagcgtaatttctctcaaatagttctggtagagattcgtcagttttcataaaggatcttaaatattccaaacttagaatgtcagaatctccttctggaatcaatattccaaacttcaaaaattgcacgccaagccataatttccttcttaaattgaataatcttggataatcgtccgattcgctgacgtatcgagtgtattggaagggttcttcattcagtcctagctttattgctacattctccaaaaattttaggtttagtatgtcactgtgagtaggatacatgtcagcttgatctggattcaaataccgcaatatgaaaaaatagagcagacaacaaagtgtatgttcattaacatattgaaaaacgttcatgagagcaagaagtttatgagcgagtagcgttaaattattcgattttacaccaaaagattctttaaatgaatgactagtacttagactcaaacgtctgtaagaaaaagccaatatgatagttagcagtgttattgtctccagttttcttctagagtctttgcccgcaaatacaatgttatacccattaaattcattcaattgcaacagctcccttatgttatcttcgaataatgatatttccagtaacggatagaccggatatattgttttgtaaaagtccacgattaagccatcaacctcattcttattgaggaaatatttggataactcttccaaaaggatgtttatggaaattttatcattattttcttcaggatgcgcttgttcataatcatacgtgttatacagaaaatctattggaggatacaatttgcttgtttttgaggtattttcaataaatttaagtgcagctttatcaataaaaaacaaaggtccaatatcaccgattgttaagttaagttctctttttttattgttggcagaaacgttttcacgatggcgttcgacatcaatcagtatcctctcatgtatgcaggtggtcaaggccttcgcatacaaatcatgttgaagaatgctatggaaggcaaaaggactatcaacgatggttgtgttattcattacaacaagcttgtcgtgtgcattcgataaattcatggcaaaatttttcatttcccagtctttagtacttggattaagtatggaagtaaaggaaccacttgcggacatcgatgcaggagtaatgtttctaatgtctctatgtggggcattttcgatagtgggagatttgttaatccgtcctggttccacttcgtagctacaaatcgaggatgaggccttgcatttggagcaagtaggccaaagtttatcacatttgattttcctttgcttacaccgcaagcaaacaaacgatggcttaacctttttctgagatgcaatgctcatatccagtgcagtacacttatcttgtcatagatttctgatgggtaaataattacttcacatcatctttgtttccaaagtttggcctcaatgttgcctttaggaggaaaaaatgtgaagaatgcatacttctgccgcttacgtaaaaacagaactctgaccagaagagataaaaacaaaaaaaaaataaaggacagtaaatatgaaaaataagatattattatattaaattaaattaaattaaattaaactacgatgggagcgttatgccaaaaaagataaaattctgagcagactactctcagtcttccttcttttgacctgccgccttttcggcattaacgtatgtagtgtaatcaaggatttgtaataattgccacactgaccaggctaagaaggcacccaaaagtgggctaatccagtagatccagtggtaatgagggaaatatctggcagcaacggcggcacccagagatcttgcagggttgacaccggtaccagtgtaaccggtcaaagccatgtgagccatgaataaagaaataccaattggaagcgcagccataaagttagtttcacgtttttcaacagcagtcatcaaaactgttaaacacaacacagcagtaccaaacatttccaaaaacaaccccctagatctggaacagcctaaacccaaagcattagtaaagagaaccttgcctggagtcatagcactagcggcaccaccagcagccatcccagcaatgatctgaggaaaccacatcactacacatctggctggtgagatggctctggccaaacacaaagagagagaaacggctgggttcaaagccccaccagaaacaccagatagaaaacatcacagagaaaccgaaaccaagggcaatcatgatcaattgacctggatgagagccctcaggctcggttgtcaaagccacatcatggttagcgacattacaaatgacgtaagcacaccataaaaacatgaaggtaccgcaaaactcacccacagcagcgataaagtggtttcttaaggtatctctgtcaatattaaaacgcgaatgcttcgtttccggctgttcaggtggaatataagcattgtcaacaccggtcgggtccaagtgcgaaatgtttttttcaaggtcgttagattcgttagacatagtataactaaggtaggctagtgtcgcttttgaatattttcaggaattgtaatagccaggaacaagaaaaaagacatgcgcacactaataagctactaaaaccaacatatttatactatcaaccgagagaggggcagatatgattcacgataaaaagttaataaaaggataacagcggcgctctaattcgttaatgaaagccatagtccggtatggacaaaaactatttccttcttttttttttttaggtttttttttaatttgcacttgcaataatctaattcactgtaggagtttaaagaaaaacatctagaaggattggaggaggtaagtcattattatggcggtgctcttttagcgggaaaaaaaaaaatacacctacgacgttaaaacagatcgtgctgtcgtctcagcggcagtaaaagtactgtagtagttacggtgcacgcagatgcaatgctaattaaataatcatgctcccatttttaagaagcagaaaaaggccgcagtaatttgagccgtgaaaagatttcggagggttgattcttaacattttccaaaaaaatgtcctttggtctgtttgcttgggtctgaaaagaaggactgcagcgccacctccactggttaaggacaaaatccatacttattccatctttctcgggacatattttcctgagacaaaagaccgtagaacttcaaagactcgttcccagaaagggatttagagttaatttttgctcggcatcaagccggaaaaattcaggcgccgcttagtaattaattgcaagtaaagaagtaccggatttattagacatcgtcttagcaagcaaattcctgaaagctaaaacgcaaataattaactaaaaatagttgctaaagagcaccttttatgcggtacataaaagtttttagtgccgtagatatatgtagatataggtgggcgtaggatcagaaggagccggagagaagatttaccaacactgatattcctcgaaatactctataattctctctgggtaaccgaggagtttttgagaaacggtgtttctaacatcgtccaccagaacaggagggccgcagcacacgaccgctaatgaatctccaggcggcgtactttttattgcgttttcaattacattgctaaaattaggtcttgcattgccgatgtgggcgaagcttgtcagttcggtcattatatcatcaaaatgtattaattggtctcgtgcgtttgctgcctttgtaacagctgttttctgtgtaaggtaaacctgcacgttgacgtgggatcggctattttttagctctagtatctcggatttatagccgttaagaaaagaaggatttttgatcgccatgatcaaatctatactcttgggtttatcagggtttcgtgacagcttaatggcatgatctaatggaccaggcaagcctgttcctccacttagtaacagcaaatggtcgaatttatcgaggtgaagattactgggcccataaggtccctcaatggccactcggagttgtaatttaccatttaaagattgcaaaatatggttataaatgaatctagtgagaccacttttaggtttgatcactaaaacacacttctcaccttcgtcgataatggtaaatggatggcattgccaaaataccaatggatgtaaaaaataaatgaaacaatattgacccggtttcgaatgccatctccggttatatttgggtatgattactttaaacatttcatcgtgcgggttgttgctggtgttcaaattgattagtgttgctttcggaaatctaaactgcaaaatgttccatattctgaaaagcttttccagcccccaaatgagcaaggataccactatccattctttccaaccgttgaaaattttgacgtgttgccaacaacagtaaaagaacaaaagggctagtatgatgtgggtgtacaggaaaaattcgtaatgtcttttccttactattccgagcgatagaactagtagaacgcaaagcactgttatggatgcaataccaaacttccaatagagctgtttgttgcttattttgaaggcatggttgataattgcgaataatgaataagaaagcgaatgtatcgttgcgtttaagaccatgattctaccgatccatttatggaaactaataaaggaattgaacttgactcctgttaaaaattcgagaaaactattccttgccgtaaaaatgataatgagagggaactgagtaaacgccagtatcccagatctatcagccaacagtcttgtaaactgcgacaggtgactgttgaaaatgaggttatatgggtctatgatgtaacttatggacaaaaatatgatgttcgccaatgtgtatccaaaaatgatccatgcctccaaggaattcggcatcagtcccgtaaagacttccacgtttagaaacttgaagtgattagcgtgcttatctactaaaaacgtaggcaacacaaaatggccccgaatataattgacgaaccggcttgcaaatagcgctcgattcaggccgttatagtgactcatatggaagaagacggcgataatacccactatgacgaagtagtaagttaaatatgcaccataaacactgctgatatctaaattataggcatgcgcatgaaaagctcgtatccatctagatcttgtctcacgatcgactcgaatggatgtcgataaactttcaatagaaccatagtcttccaaagcgtgagaagaagcattatttaaagatgagtagtattgctccagtgaaatattgctaaactttttatcgacaaacgagcacgtttttcgtacgttacccaagctttcttcgaaacttgtgttgtccatgggaataatctggtctgtaagcgaattgaagatacaaagtgaccaagtatcaaacgctggtgaataagagcatatggtagaatagaaacccggtacgacggagctatcaaatgaccacttcagagtatttatataggatgcgcatgccagcacagcgttggattccaaatggtcttttttttcagtgtgtggtaattttatattaaaagcctttgttaaagatatcagccacgttaaaaacagaagcgttctatgcatattcaacgagctatggtcgtcatgcttcactttagaagattatagaaaaatcattgctgcctggttcgatgaccttgtatcttttcttgatctacatggccagtatttccgttctgaatttagaattacaaatatgggtgcaaaaacaatgcccactagccggggtgtacgggaccttaaatctaagtattgtgttttagatagagttgcgaagagaaaattataattataataattctatacatgtattctgtatatatatgacgattttatatatagatatacattttcatttttcttgaagattgttgtcatttgtgaaatcatttaccttaatgagaaccagcgcctctgctgactctttccaaaacagaatcgtaagaaacttcggaaaaatcagtaccttgaacatcggtagagacaccgtttaaggctcttcttaaggcatccttggaggatgcatagaccatcttagatctgactggagcagtgtctggagaccaagtgaagaaaacaatcttggatctcttaccttcattaccattaatttcgtattcaaaatcgtaaatggcgtaaagacagtcgttttctggcaatttctctaagaaggcatcgtaagatgggtcagtagaggtttccttgacaacgatttcggttttagcatcgttcaatccgaataaaataaatttgtattttttacccaatttcaagtcattgaaagcggtaagggattcatcagcaacagcaacactacacagaaacttcacattttcctggcttcttatgaattttttcccccacattccttttaaagttccatgttaaaaagggaggaaagaaaggacataagagagcgagataaaacagcatcatgtcaattagttagtaattgatagtttacacaggagtacaaatgaaatttagcatacccagatctagacatcttcttttgttagttttttgtttatgtatgttttgaaatctgaagtttacgtagttgctaaccagtcttttcttgtttcctctttttcttccaattttgtcatcaaacaggggcggcgtcacccgaatattgttcttattacccggatattaggtaatttagaggtactgcatatagtataagtgattgatgaacttatagaatgttctctcgagcttccaaggccattagcctctaccaaaggaagtttgatgcctggtcttaagcttgttgaagctttagaatacaggtgtgaccgattggagcggcttataggcgccggatacagcgcgaattccgatgtttcagtgcaattagatgaactatacaatcagttacatcgtctatatttccagggtctaaagtattctcaagatctcctgcaactctttaatactttcatggctgaagacatcgagaacgtgggagctcctgatgatatttgtatttttgctagttgctttgacgatatttatacattatatagtgcatttgacgaactaaacagccaatatatggagttttgccaaatcagtaaaagttcattggatcagatttccttcaaagacgcaaatattgaaacgaaacagttgaagaagttacccgagttggtggataactgcaacataatgattttgaggtcaattgcaattctaaaccgtttcatcgactggaatattgaagttaacggattcttccagttccagaaaaagaggctgttgaatttacaaaaggtaatttatagtacgtgaacatgtgtgcgtatatacatatatatannnnnnnnnnnnnnnnnnnnntatatatatatatatatatatatatatatatatatatatatactttagcatcgaaacagctagcctttttagagttcaatttttccacaaaggcttttttagccaattcaattaggatatccaattctccactatgctcacacatgctataaaaggcactttgtttgttaagtaacaaagaatatgggtgatcatactcttttacctcacctgcatccatcaccaaaattttatcataatcgataacagatctcaacctatgtgcaattgtcaaaattgtactaccttggaactcttttcttatggtttcttggatcttcgcatcggaactgtagtcgatggacgctgtagcttcgtccagcaatatgatctttggactcctcagtaaagatctagcaaggcacatcaattggcgctgtccttgagacaaattggatccaccttcgctaatttcactacttaaatccaagaatttattaacattttcggagttagtcgacgaagcctcattgcttgtttctcttgtggcgccttgttgtaattgttcttcactaattagatttacacgtttcaaagcttcaaagatctgtctgtcactaaattcatcatatgggtctaggtttgttttaatcgtccctgagaatagtgttggatcttgtggaataatagttatagaacgacgcagtctttgtaaatcaacaccggaaatatcgatattatcaattttgatatggcctgtctcaggttccaaaaatctgaacaaggcggtaataatagttgatttaccggcaccggttctaccaacaataccgatcttagactgagcgtcgacagaaaatgaaacatttttaattactctaggtagatttggagcataccgtaatgataaatcattaacctcgattttaccgtcttgtggccattgtggtggcggtatttctttgtgttcgttgtatggctcttgctcaatttccatatattctttgactctttcaacagaattcatattcatctccacttcagagtacaatcttaccaaccacaatgccccttcagtgaaggaaatagcatacgtcaaagatataccagccatacccgaatccagattattaatattgaatagaatgaacaaaccagctccaaaaatgaccaaggatccaatcatatctatcctaaaggccaaccaacgattagcaacccacaagtagaagaatggtttattattttcatcaattttgtgtaaattctcttgcataaacctcccttcatcaccaaacgcacgaatggtggtaacaccgacaagagtctcggaaaaatgttgatagatcggtgatctagaaatagattcaaatcttttcaattcacgagaacctgccatgtagaaatacccaacaaaataatacaatattgaaacaactatagcaacagataagaactgtggagtaataaatgtaatcagtatgacggtggataaacattcaataagcgaatagaaggcgccttgtatataaggtgtcagttcctgatcaatagcttcgatatccttggaaaacctgttcataattctacctgttggagtagcatcaaaaaatcttatcttggagtgtaaaaccttgtttagaatcatattaaatatctttcttgacgcgttgataccagcaacgaaatttaaaatagttttaccagctcccaataaagcctgagcaaaaccaatgattaggtacaaaaccagataatacattgtagagtgtccactggaaggttggttttcagctgacgccatactgatttgggacgagcccctccaatcaattagatgactagccttcttggagataaatgcaatagcgcgttgtgctctgggaataattttagcaatgacattgtgtgacgcccaggcacgaacccaccatgattgtccgatatacaaaagttgggctatcaagaacaaggaagctaaaaatgaaacaatcttccaaccaccaaaaattttcaaataccatttatagacatccagaccaaccacaccttcttcttttgtttcctcttttattaatttaccatcttcagtgcgttcagcttctgtcctcaatgatttttgaagtttcttggcttcaaagtgggaggagttgttgttcacgctaacttgttgttctttgacagcgggtaggttacttaagcttgtgctactttttgcggctaagttagcagaagagtttgcacgcgataagatactacttttcactaactcgtcttcaccaaacaaacccttctgtaacatgtctattggatcaccttggtctttaaccctaccatcttctagtaagactaccaattcagcatttctcaaggtcaaggcgatgttgtgtgaaaccaaaatacatgtcctatcttccattaatggtccagtaatacaattatcgtaaatccaagatgcagtatgtgaatcaactgcacttaaacaatcatccaaaaggacatgcctagcattggaatacaaggctctagcaagggagactctctgcttttgaccaccggataaagtaatacccttctcaccgatttctgttaggtcaccggctttcaagatctcaaaatcacgtttcaatccgcatgcttcgacaacagctttatatcttgcctcattgaatggactattgaataaaatgttgttttttacagtatcatttagaagccaagcggcctgagaacaataagcgatagagttagtggttccattcgcatctactattagttcctgccttggttctagagctgggacgacaaccttaccattgagtagatacatttcacctaataatgccattagtagggatgtcttaccagaaccagtggggccaataacgacatttagtttaccagttttgaattcaatgttcaagtctttcaatttgaaatcttgattgtccttatcccaagagatggtggaattctcaaaggcaaatctgtttccatttggatctatggtcagttgatcgtatttctttgtatcattttcatttaagaaatcctgaactctatctaacgagacctttgattgaacgacaaaacttaacatatcagacaaacgatccaaaggatctcttaataacgtgaataaagaaagtgcagtaaaggcaaccggagtggttaatacctcgccttgaacgtaaatgtagtaagcaaatgaggcggctgttacaatagttggggtaacaaaccaaagaaaggaactgatagaccaaacaatggatctcattagcagtagagataattcattttctctaatagtattgatatctttttcaaaattctcctcccatgaaaagtatttgatgattctgatagcttgaaaagcttcattcaacttttgaatacgattatctgtgacagccaagtttttcttttgcaaatcgccgatgtacttggcaagcttataattcagtggaagcattgcgacaatgattaagacacccacaatcgcagcaaaacccagcagacggtataacagcgccagtgcgacaacagtcataacaaaagcctccaaaaatgaatgaaggtaaccacaaatttcagaaaccttgaaagcgtcaatagccatgagattaataatcgctccaaggttggcagaagaagtggactcctcatcgccgttgatacttttttgatcattaatttcctgtggatcctcattagaaggtttagtcttgttggtggaaatctttcttctcaaagctttagtataaatctcagagattataatacttttcattctgatacaaactctccttccaaagaatagtgcctgtgcttgacaaatagccactaatatcctacctacaaacatgacagtgacgtaaaaccaagctaaatttgagggagcagatgactgatcttcaacatattccaggatcctttttagtaaaactgttggaataaaagaaaggacgctgcctaaaaatgcccaaaagcattgtagtaccaaataattcgaaaagaaaaagaaaaggtttagtgaaaaaatacgcttccttttaaccttatggtcaacaaaatatctgaattttttcactacaaagaaagaataatcttgcatcatcaatccccaaatatccttaactttgatactaactttgtgtgctttccaaacaaaactgtctaaccaagcccagcatatgaatccagcaatagaagtgactggttctggagatggagtaatccagctgtcagttttatagatgatggcaaaattatttcttatcctcgcaaaaaagagtagcaagaaaagggcaaggttaatcgatatttgtgaaatgtaatactttctcgaaataggactgtttatatggtgaatgaaaatggaacgaaagggtaaaatcatagagataaacaaggccaaatagtttatgaacgataccgaccatagatttccgggatatttgtttatgaatttgaaattttggttgacatttgctaaacgtaaagagacaatgataaacaatgcacaccattctaccaaaccagtaatcgtaccttgttgggtgaactctgggtttttattgacatagtgtaatagtataaaagaatgtattataacttgagaaagtaccaaaaaaaattcaaggataattcttgatttttcaatgaagcctcttctaactatttcaggtgtaccatgaggttctccatttaccttaactgatttcagcttttccagagaaaagtgtctattttttagtgcgtcttttgtacaattattgtccacgtaattagttgtgatggtgttattatttatcaacggactctgttcgtcttcgtcggtagatgagtataaaagttcatcaattggatttttttgcttcaagtgtagaacgtcatagtagtaataatgtttccatatgttataagttatgaacaacaccgtgaatattaaaagcactaagggagtataataattaaggtactttgttctgccgtactgagttacgtcatcgtaaaaccaaaaccgatggtcaggtctcgttgaattgagtacgtgatgcatgttctccgtagcttttccccccttgatgagctcttctaaaaagtacaaaatctaggaaagtataatgtttcttaaatgcgatgaaatgaagtgaaaagaaaaagcgactggcaactataaagaaacaatgccggtttttcgcacttaattgttttcaaaagatcacttgtttatattagctgctaaattgtttattctatttaaaacgtgtagtaaggaaaaggcctgctctgtagttaatatattcttatctgaaaattttatatacttcattagtcacaacgtacgttctttgcagatgcgcacacaaaaaaaaaagggcaccaaaataaaggaggatgcgaaggtatgacacattttctggatacctttactggctaactattggttgtgatattttgcagagatgatgagaagtcaaagcaagtatactagctattttttttttttaattttgttttatttttgtattatctcctccttcttgtttctgttcatttttcttggcagaggctatcttaaccaacaatactctaccattacttgccttccgacctttaaattctcgacatttcttttgaatactatctccagtccccaggttgtcaaacttgatgaaggcttcgccggtgtgaaactcgtcggaaaagaaaactttgtttgttctcaaatccaccaattctcttcttacaaagtttatatttttagggtcaacaccaaagattttggcaaggtcttcatttgtcgatttcatgggaatgtttttcacatagagagtatttgtggatagtggcttgagatcaggagcagttttcttgtttgatttctggtttttttcaaaacttttttcctcttttgttaagatgttttcaataacaattttttcattcataaaaattttaccgttcatcttctctttcacttttttcagattcacaccctcttgaaattctataaatgcaaaccttttcagcggtttcttgagtggctttttctttagcatatttattgttatcttaccataatttggctcaaacaaatctctcaagtcctgtttacggcagtttttaggaagattgccgacatataatgtcctcctatcatttagtactcttttttttatttttgtattttcaggaacaactgttgttgttttttttccgttgacgttataaaactctatctcctctattagcattgcctattcttttcttaaaagtttctttcttcttaattttttcaagattacttgggaagatgccctatttccattgatttgaacgtatgtatgaatgaaaaggaagtgagaaggaacaagagaaaagaacaaaagagtttttagtttttatatttgcttacaggaacttcggcggctatttgttgtatcgtcgacagtgacgctgattctttcaaatataaatagctgccccaattagttttgcttggcaaaacccgacattgatgaactagtgccgcgcttaaaagtataatgttgctctattatttttcaaaaattcatacaaaagaaaacgggaattaagtaagtatacaaaatataattatattacgatgttcgaaattctatatatgaatttaagcggagtcggaagtcttagctctcttgtccatcttagcttgagccttgttaccaaggataccaccgccccagtgcttcttgacttcatcgtatttgtcagcgaagttagcgtcaatggtggaaaccaacttagccaaagcagcttcgtcttcggctctgacttcggtcaaagcggcaacagcagaagtcttttggttaaccaaagtacccaatctagccttacccttgataatggcgtatggaacacccatcttcttacacaaagctggtaggaaaacaaccaattcaattgggtcgacgtcgttagcaatcaaaaccaacttggccttcttgttttcaatcaaagagacaacatggttcaaaccgtacttaacagcgtatggctttggagaagcgtcttgcttagacttaccttcagcgatagcggcagcttccttggtcaatctttccttcttttcagcagcggtttctggtctgtacttgttgaacaacttgaaggtttcagcagcggtgtttctgtccaaagtgtattggaattgagcaatggttggaggaaccttcaatctgatggacaagatcttcttttgtctttgcaatctgacatattctggccatttgacgtatctggacaagtttctctttggttggacagcttggccaataccgaagttctttggagtagagtgagtcaatgggttcttagccttgttagacttagtggacttagcaccgaatggagctggagcaactttcttacctggagccatcttttctttcagttatcgtgttcactgtattgaaaaacagatataaaaaaaaaaaatagtgaatttcaacgtgcgcatcacaatacttatgtcttgataataatatcgatcccatactattgtccctggattttgagatgggaaaagtttcaatgcgttctatcgtatagtatgatgtattcaaaaaaaatgcgataattctttagttgtcggcacttcggaagccaaaaaaaaaaaaaaaaaaaaaaaaaaaaagaaaagggtgtctaagatgtacggatcttcattgggatggaaaacaggcaagtaaaaagaatagtaattattacaatggagaagataagataaagttagcggcaacaaataaagaactcatcagagttcttggcttctctatgagtgaaagtgtttcaaaggtgtttttttatgagacaacagtaattcccctccttcagaacagagtgtagtgattggcagtgaagctatccctctttgccacccaattttgacggcagttctcatagcatctcaaagcaatagcagtgcaaaagtacataaccgtaggaaggtacgcggtaggtatttgagttcgttggtggttatcctccgcaaggcgcttcggcggttatttgttgatagtcgaagaacaccaaaaaaaatgctgttattgctttctccgtaaacaataaaacccggtagcgggataacgcggctgatgcttttatttaggaaggaatacttacattatcatgagaacattgtcaagggcattctgatacgggccttccatcgcaagaaaaaggcagcaacggactgagggacggagagagttacggcataagaagtagtaggagagcagagtgtcataaagttatattattctcgtcctaaagtcaattagttctgttgcgcttgacaatatatgtcgtgtaataccgtcccttagcagaagaaagaaagacggatccatatatgttaaaatgcttcagagatgtttctttaatgtgccgtccaacaaaggtatcttctgtagcttcctctattttcgatcagatctcatagtgagaaggcgcaattcagtagttaaaagcggggaacagtgtgaatccggagacggcaagattgcccggccctttttgcggaaaagataaaacaagatatattgcactttttccaccaagaaaaacaggaagtggattaaaaaatcaacaaagtataacgcctattgtcccaataagcgtcggttgttcttctttattattttaccaagtacgctcgagggtacattctaatgcattaaaagacatgagtaatcctcaaaaagctctaaacgactttctgtccagtgaatctgttcatacacatgatagttctaggaaacaatctaataagcagtcatccgacgaaggacgctcttcatcacaaccttcacatcatcactctggtggtactaacaacaataataacaataataataataataataacagtaacaacaacaacaacggcaacgatgggggaaatgatgacgactatgattatgaaatgcaagattatagaccttctccgcaaagtgcgcggcctactcccacgtatgttccacaatattctgtagaaagtgggactgctttcccgattcaagaggttattcctagcgcatacattaacacacaagatataaaccataaagataacggtccgccgagtgcaagcagtaatagagcattcaggcctagagggcagaccacagtgtcggccaacgtgcttaacattgaagatttttacaaaaatgcagacgatgcgcataccatcccggagtcacatttatcgagaaggagaagtaggtcgagggctacgagtaatgctgggcacagtgccaatacaggcgccacgaatggcaggactactggtgcccaaactaatatggaaagcaatgaatcaccacgtaacgtccccattatggtgaagccaaagacattataccagaaccctcaaacacctacagtcttgccctccacataccatccaattaataaatggtcttccgtcaaaaacacttatttgaaggaatttttagccgagtttatgggaacaatggttatgattattttcggtagtgctgttgtttgtcaggtcaatgttgctgggaaaatacagcaggacaatttcaacgtggctttggataaccttaacgttaccgggtcttctgcagaaacgatagacgctatgaagagtttaacatccttggtttcatccgttgcgggcggtacctttgatgatgtggcattgggctgggctgctgccgtggtgatgggctatttctgcgctggtggtagtgccatctcaggtgctcatttgaatccgtctattacattagccaatttggtgtatagaggttttcccctgaagaaagttccttattactttgctggacaattgatcggtgccttcacaggcgctttgatcttgtttatttggtacaaaagggtgttacaagaggcatatagcgattggtggatgaatgaaagtgttgcgggaatgttttgcgtttttccaaagccttatctaagttcaggacggcaatttttttccgaatttttatgtggagctatgttacaagcaggaacatttgcgctgaccgatccttatacgtgtttgtcctctgatgttttcccattgatgatgtttattttgattttcattatcaatgcttccatggcttatcagacaggtacagcaatgaatttggctcgtgatctgggcccacgtcttgcactatatgcagttggatttgatcataaaatgctttgggtgcatcatcatcatttcttttgggttcccatggtaggcccatttattggtgcgttaatgggggggttggtttacgatgtctgtatttatcagggtcatgaatctccagtcaactggtctttaccagtttataaggaaatgattatgagagcctggtttagaaggcctggttggaagaagagaaatagagcaagaagaacatcggacctgagtgacttctcatacaataacgatgatgatgaggaatttggagaaagaatggctcttcaaaagacaaagaccaagtcatctatttcagacaacgaaaatgaagcaggagaaaagaaagtgcaatttaaatctgttcagcgcggcaaaagaacgtttggtggtataccaacaattcttgaagaagaagattccattgaaactgcttcgctaggtgcgacgacgactgattctattgggttatccgacacatcatcagaagattcgcattatggtaatgctaagaaggtaacatgagaaaacagacaagaaaaagaaacaaataatatagactgatagaaaaaaatactgcttactaccgccggtataatatatatatatatatatatttacatagatgattgcatagtgttttaaaaagctttcctaggttaagctatgaatcttcataacctaaccaactaaatatgaaaatactgacccatcgtcttaagtaagttgacatgaactcagcctggtcacctactatacatgatgtatcgcatggatggaaagaataccaaacgctaccttccaggttaatgatagtatccaaacctagttggaatttgccttgaacatcaagcagcgattcgatatcagttgggagcatcaatttggtcattggaataccatctatgcttttctcctcccatattcgcaaaagtagtaagggctcgttatatacttttgaatatgtaagatataattctatatgatttagtaatttattttctatacgctcagtatttttctgcagttgtcgagtaggtattaaacgcaaaagaagtccatccttttcatcattcaaatggacatcttggcaaagggcccagttatggaaaatctgggagtcatacaacgattgcagttggctatgccactcctggtaaggaatcatcaagtctgataattctgttttttagccctttttttttttttttcatggtgttctcttctcattgcttttcaattttaagttcgttacctttcatatagagtttcttaacagaaatttcacaacgaaaatataattaactacaggcatgtaaatataaaaacagtcctttaataataaaccttaagcattacgcgtgtattaatataataaatagttataaattgaataaataggggagagaagccaaaaggcccttcaaaaacaaagatataaattcatccttaaaaacaacaatacctgaagatactagaacaccttgtcgcctatgatggacatatatacagaccgggtcatagcattgccaatgataaataaataatagtcatagagagtaaacataaacgcctaacgtataggaatgtgtgagaatggtgagtttcgtccttgaaaataataataataatagttggtgcttttattagtgccaaaatcatttgagaggcttctgagttcttcggggctagctgtttttctgatagtctaggcaaatgccaaagatttcttaatttcagcaatagccaaaccaggattcaagccctttggacaagttctagtacagttcatgatggtgtgacatctgtacaatgacatggagttgtttagcatggcctttcttgtctttgtagcttggtctctagagtcaattagccaacggtaggcttgcattagcacggcagggcccaaatactgttcttggttccaccagtacgatggacatgaagtagagcagcatgcacacagaatacattcgtaaagaccatccagtttcttacgatcttcaatactttgtagcacttccgttccatcctttggaaacgatgatctctgtaagtaaggttggatagatttgtattgttggtagaagttagttaaatcaggtaccaaatctttgacaataaacatgtggggtaatggatagatcttgagttgtttggattcgttctggtcgatcttacatatacaagctagcgtgtttctaccgccaatgttcatggcacatgaaccgcagataccttctctacatgatcttctaaaagttagggtagaatcctgttcgtctttgatctttaacagcgcatcaagtaccatgggcccacagtcattcagatccacttgatatgactgtaaatgaggtttagcacttggctcgtctggattccatctgtaaactttaaaagttttcaatctgggggtatgcgtagctgcagctgttgtggcagtagccatacccttcttcgtcaccaaacaaaaggccttccttctcaatagcacgttcaacatccctataaatatgtatactccagtatttcaagaaagtatagctcaactatattcctttcaatcccttcctttagcctaacattttttggcattctcatagaaagtcattaatccccttatataagtttgccctttttacaccggagctaattgggccaatgcgaggccgccttttgcgcgctgcggatatttctaaggcatggtcgtgcggagctacaataatacgattgaattatagctacatagtgtacaaaagcgggtatatactttcatatgtgatcataggatagcttcacagtacttattgtattctctaacagcaatggcgatgttcctgtacaaggaccgacgttcttcaggatcgctgatgggaatgaagtattcggattgagacttgagtttaatttgaagaccggatctttccaatgtaattccctggatggaaggatatcctgtgctccacataagctcttgggtggccatttgcacctcagcaatgtgctgcatggacacaattactgctagttctttgcctggcaatataacgtgcgacaggtattcatcattcataaatactcctccattcacggtcttgagccagtattgtccttgggcctcacgtagatcataaggcttgatgatttgatcatggtccacgtaccttggtagacgcactctgcaacccttttgcatgtcaagcacagtggtggtacttttcacgccttgacttaagttacttgtaagatctaagaatccaatggctgtcttagttggcagcccaacgatacctttaccaaggcctttgaggaaaccagcggcgccttccttttgcatggccttgtatgggtccagtgcaattccgctcaacccgcttcccagtgtgctggcaaaggattgcgctgagtttgccaaggcattcctgttgtttttatttattctttgttgtaatctcctgaccctttggaattccagatcttgtgtaactgacaggcccttggccatcgaccccgtaaacttggacatactatcagagaggccaaagactgttttctttgcaaaacttagtccacctttagccagatgtataccaatttcttgaggcctatcattcatcatgtaaccttgatatggttcatagaataagtcccagacaccggaactaattgtgttgaaaagacctacaggattaccaaaacaatctgctgatcctaaaattttgtggatctgatacacgaactgggtcgtatagtgtctctcaatatggtccatcagaatgggcaatgggactcttacattatccatgaacaaagaattaactttaaccggcgcctcatttatattacctaatgtcatagcaaacatatggacatagtacaatgatgacgaaaatgactcctcggtctcttcagccaatcctggactaatttcatcggagcgtataaaggacagatgtaagacggtgggctgaatatggaagatctcgaaatatatatcacccgccgtttttaattcagaaacatcaggtaactggatttcttcatcgtacttataatctcttgaatccatgatccatggggatcctgggaattttatgaagtccatcatagcatacagcatgtcttcatctaattgtatggaaaattcctggattaataacgtaacatgtttaaagtatgggacagcctgtaaggaatcgttgactttagaaatagaacctgatatcactggatgattttcaatttccttttctgtgtaggggatttctgttggatatagaatatttgagtagtttcctgaaaataattgattatctatttgcatccatttcattttccaactgaaagtctggtatgctttagattcattgtatcttaattcgatccctctcatgttaatatatagaagttcctgtaaacgaccattgattaatgagataccaactcctttgaacgaaacaactatctgtgtattaaccttctcatcctcatccttttgcacaaagccatcagtcactgaactatttactgaaactgaagacgtggtagttgcagaggcagttttcaatttgtataacccaacattggccttatagttaacaataactaaggcctgcatatcgtcgtcagcaacaacatgtaatccaacaatgggggctggtttatcctttgaccttttatccaggcgtaacggtggcaattcgccaatctcagccaaccgaacttcccttgtacgtgtacctgattctaacaccagatatttctccttagctgtaggaaaatcccatgcgtatggcataatacttttcgagggaatcctgtaaaagataggtttgaaactacggcttgaggactcgttagactggtcatccttgtatggatcactaactttacgaggatctctttggtaaaatataaagtcatggtcgctgaaatttcttatggaaaatggccatctgtcaccaccgtccttgattcttatgaatattgttgctttgtccaaaagaatttcaatctttaaaagcttatggcgtgaatttttcaaaactttcaaatatgttacaccgacatttttgataaagaatggttgtgaccaattggagtctccgcctaagaatttcagcactaattgcttgtcgacgatgtttctcatcctgtataaaggcttagtgatgttcgattctatttgctggacatccatagaccctgtctcgcaaacttcaatagggatatctaaagtattgcttataatatacctaggtgcaatctcaataactttacttagcaagtacttccctttaccttcgctaatgttgatgcctaaatttgattcttgttccttattttttatgcgaacagatgcatcaaatgattggccaatagcgtcaaatgataatttggaactccactctgattccttgaacctaatacgagctctgttacttttatcatcttctttatcaaatgaaaacatttttggaatagtatatcttttttcgttttcaagcaaaatcttggattgtgcaatatttaagagactactttgaatgtagagttctctatcggtagagttcataataatataaggggagtatatccgaataactttggaccttgtaccatcgatgtttttataatctagtttcaacaacaaattctgacctccagatagggtcaaagacaacgaatcttctgggtttaaaggacttttatgtggtgtattaacgatggagggctttgaagcagaagcctcatcttgtaatggttgaacagacattagcaggaaactatccaaagaaatatgatgaacttccatactttctccagtcttcaagaaatctgttctcttctcctctcttttgtcaaaaatagagaagttaatatctgctggaagtaaattttcaatagtcatagatgccgaaaccacgattttcatatgaggaaagatctttgccaatggttctctttcatcatactttgcaccaatttcgaaatgaaatctttgattggaatcttcttttgaagaacagaatatagacatttggttgctcaacaagcttttccaagataacgtctgttgagaccaatcgtatatatcctctgatgcgggtcttatcctaatatcagaatcgtaggcatattctacaggaacagatttactttgatgtggtttaatagcatattttaaagatggcttatttggatctttggagtcaaccaaaagctcaatctcagttgaagttgtgttttcgataactaaagttgacctaaacgtaataatcttcacgttattctcatcacatctggcctcacaaacaattctattatgcacattatttcttggtgggctcaaaacatgcaagttttcaccttctgttgtggcatcaatattcataatggttttataattttgcccagaaacacaaacacccaaaatgttcttcgacttatcaatatccaatttctctctaatacttctccaatcttcaaattcccaaggaagagaagtgtttgcttttaagagcacaacttcgtttttgttgtcttcagtcgttttatcctgtatccagacgtcaaaatctaattctgtatcgtttaccagttgatatggcttctgagataccctggaagctaagggcagctcttcggttagagacgccgggatgtgagaaagcatagcgattgacctagcagaaagtgtaatttccgcgattctttgagttaaaatatcaaaagagaaagcaggatccatttcagaatgcccttttgataggtggaatgttattggaatcatctccagaagtggctcccagctagatctcgaatagttgaatatgttaacataggtttctagagaagcaagagcttcaaagtcggtagaccaatcctttgctgaagcagtgatttcatttacattcatgtccaatattggcatttcatggacgtcaccaattaaaataaatctcagtccgcctaagtcagcattgaatgtttcgtttttcaaaattgcagtaggcacttcaattgattcggaatctgagctctggctagccctgctgcgctcacctaaaatgcttggatccaacaccgctaatttcctttcaaattcatgagaaaattgtattttgtctgtgctctcctcctcctctccattatcctctttttccgtcatcttatttagcaatgtggtaactcgtttgaatattaacatcgccagacgaatatctctaagtgaaatacgcatcaacaggggctgaacggaaagctgtatattcgtcattagggtctgaggagttgagtttcttttatcaattgtcaaggaggatgaaaagtcgtccaataatctcaatttttcttcagacgaattcattttgaataggaagataccaacattattggctgcaactgtcataatattctgatcggttactaaaaattgtcctatcttgaaagaaatagcctcactattcatgtcgcaaggatcagcaagtaagatcagagccgtttcgatgatattaacagagtattggattttagtcacatcaccaccttcttgaacgctttcaacaatagccttgttttcaggcttttggtttgtgttttcaggatagtataaattgttttcgtggcttttggacataattgcatcaaaaaattctttgagagaaaccaaatagtccattgccaaaatcattttcggactgtccattgtcatcgaaatgttcaatagccgtccgacctctaagttctttctggaaatattagccacaaattgatattctttattcttactctttggtattagttctgtatgcttattatcttttatattacgaacatcttctatccggaaagcagcaacatgtgcttgaccatcgacggtcccatcattctttaaaccaaggctgcacccaatgtcttgaaacataattcttgtcagaccacagtcattcaaagaagtgacgccctttgtcttgttatataaagtaagggcaatctttggagctttaaaagaaaaatccaagtatttttgttctggattttttatattgcttttattcgatccctgtagagactgaggagtagctgtgcgttcgctttcgctacttaaagaagcagggtcaggagagggacttttgatctcgccttttcctcctgattcaccagagttttcgtctgtgatattgaatgcagaggatactttattggaaatttctaataagtaagtcagctggttctcagtcaaatccaacgcaaatgattcaaaattactcgttactttaagttctggagtgtcatcttgcggaaggggatctctgtctatattgaaaagtaaacctatattttcaactagatacaattgttgactggaaccatcgaagtttaagttcgaggataattggccctcgcggacaccaagtttgatatggtttattttatgagattcgtctattaccgaaaatttgttttcaataaagaactcacccaaataaaaccgcattgtatcgtaattgttctcttgtgtgcctactaatttaggaaactggataataggtgccttgattactatgtccattttcatgttatttacggcgtcaatggaaggggcttggttgtacgctgcaagacgagctctatcaaaggatactttagatttttgaaatttagcaaaaaagttaaccattctgttaacagcactttcgataaaattaacatgcatagagcccgtagaatattttaaaaacgaatcataatctttggtatttgtagccggatcgaatgattcatagctcaattcgactagttcttgacctttcatttgaattatttttctaaataccgaatccctggaaaacgattcatttgtttcatcagtcaactccaacccgcctaattttaagttaatgttgtatctttccggtagtaaaaccattgtgaattcaccagccgatagaactaacgttgccagctttatagaatcatcattaaaaataacattgacggcctccattttaattttcatattgattttttgtggcgcatcgtccctatcttctttattatgtctcaacacatcagccggcatttctggagcgttaggatccgtaaaagtaagcattgcataattcattaaagttaatacagatctaggtgttaataccaattgcaattcactcatatgcataacaatatcttgatcgaataattcaatcaaagtatcgttatgaggcacaattctctgcactctcttgtattttagcgtaaacaaatctttttgagatcttgtcactttttcaacgccggatgatatcaagtttttgaattccttgttatcagtcagctcgatgtaatcttcaacatctaatgaatgtactcttagatctaaattcatttctttggctctcttatcaaaattgaaatttagcctttgacacaatatatcaaccaatttttcgctgtttctggaatcatttttgatacattgaaagaatgctattttcgcctgatcgatatcaaaatggagctctaagaatttctgttcaatttgaagcggctgcatattttctaacgctttcaaagtattcttcaactgcaattgaatttgcttcttcatttctttttcggaaccagaagagtaattaacgtaatcgccgttgttttcttcatcatcaatcatagaaggtatagaattagcaatcaaattcataatagtcttgtattgaatgtcatttatggaaagacttaagcgaggcaaatgaccaaaaactcttatcgtgggtaatttatatgctttaggaaggattgatagatctacagttaactctaatttcattttatccaagattctaaaatcattcgtggaagaggcggtattgatcttacctatagtagactgaatatcaggaccaacaaatatctgagtatcctgagataaaatttggaacctatcaaacattaacctattgatttcgttaccgtcaatcttgtcatattcttccggcgataactcttttatttcctttatcttctcctttggcactaaatcactgagtatagacatatgaccggcatcaatgatcgcacaaggggtatcccaatcatgtgggtctaacggtaatatgattaatggtgcttgtaaatctaaagatacatttacggtcttgtggtcttccaacaaagactcaatacccattcttgtttgtgttgtccaaccttctacagttgcctcggcggcgtttacgatattgccgattgtttccatgtgttggtttgacgccttaaaaaacttgtggacctctgtaatgaaatgaacgtggtaaaacacagtcattcccaataacttaatgtttaagttcgaatctgctaatccatctagtggattcaattcaaatgaagcacgtaataaaggttcatcctcttcttcttcctccccggtagcgtggttgtcaattgaagattgatctttagatgagtttctgacactaatgatatgtttatataacgcgttgggtgagccatcttcgagactgaatttgttcaattggaaactcgataaaaatgaatcaggtctttgagcaaaatcaactttacaattttcaaaaattatggaacccaaatttagattttgcttcttctttcgtatagtgaatgaacccttttttaacaaactcgttacacgaagttcaaccctttctctaggaacttgcagtacaggacctttatcttcattctcgtcaaattcaatagcatcataaagctcctgacgctgttcttcagtcattattaaatcttcgtctacttcttctgtaggtttaccgttccaccaagaagagagccagcttccattatttttagttgcggacttgttggaagtttgtggttcaatatttgagctagctgttggtgtgggtgagtcttccgtcatgcccaacttatattgcgcgtactgtctcttagcgacagatctgaagagaataatttcatcatacgttaaatctttatgcaattcagataattgagcctcctgaatggggtcacgtagcggagcttctaaattttttaactttaacttttcaacccataattttgtgtacaacctccgttgttcacatttctccttcatgctttcccaagtccacattttgtttttttcatgaatttcattaataacacaagcagcaatgtatttaaaccattctgtcgggttttcactaactgcgaaggatggtcttgctttcttaaactttttggtaatttgtcttaactgtatactggagaggacatgcaagatatcattatattctgtatcatctaattctaaaccaaattcatcataaaacatttgcaagtcaatgtgaggttgttcctccgtggaacccagcttgttgatactaagcttccctagcccgctaaccggtttcaaaatgtattgatgcttgggggcagtggaatttttcgatgcaatcatatctttgaaaccccttacaaaattttccaggcttctatcttgatcatcatcagaaatcaagggcggagagtctgtattccaatacaaacagagtgaatttaaagtcaatagtttatgcgtgatattctgtgtaatatcaatgaaacttggagcccagttggaatctgtagatacagctgatagctcgttcaaagttaatccaacggaagatgggcctgtagtgaagattccgtccatgtcctcgtaccttaaatggatattttttatggtaacttgtaaattgtctatgatctttgtagtcaaagactgcataaacccggcgttatttttttctgaagaagaagaagaggttttgttctctgattgggtactcagtatgcgagcctgatttgtcagttcccattcacttaccttcctcatcttcaaccgaaaagctctctttatcatctcctcatcattttcgtgatcttctgaacgtggtgagcataataaataacagtcctcgataatgattttcacgggcttattctttaaacttgaccatgggaccgttaagaccaaatcacccagtatccctgatttcacatctatgggtaaatttaatgagtccaaacagtcttttcttagttttaagttttttaacttcacatcaccactccatatgccgacatttaattgattagggtcgaaattttccacatatgagcctagcaatcggtttagcaaattagcagctaaagactctaacatttaactgttcttaattttccttttttctgccttttcccttttggtagtcacaatattctatccgtatcaaattaaatagagttaaaaggttgactcaattggtcggcttatgtgcgtttactggagattgaaacatgataggacactataaaggtggtttatattccctaataaaaatccctttctatcaaaatagctaatggtattacccggcttcgcgaaaatagtgaacgtcatagtataagacgattcaaaaatccaagctcttgaaaaccaacatgaataaagacaataacacagttgaacaatttatttagtgttctatggagtatttatcaaaaaaaaaaaaaaaccaaaaagaaaaaaggagagtaaacatatatatattgacataatgaaaatattgcgaggactgatcagttaccacccctcaacctcaagacaaggtgaagagtggactccttttgaatattgtagtccgacagcgttctaccatcttctagttgcttaccggcaaaaatcaatctttgctggtctggaggaataccttccttgtcttgaattttcgacttaacgttgtcgatagtgtcagaagattcaacctctagggttatagtcttacctgtcagtgtcttgacaaaaatttgcataccacctctcagtctcaacaccaagtgaagagtagattccttttggatgttgtagtcagacaaggttctaccatcttctagttgcttaccagcaaaaatcaatctctgttgatccggagggataccttctttatcttgaattttacttttgacgttgtcaatagtgtcggaagattcaacctctagggttatagtcttccctgttagagttttgacgaaaatttgcataccacctctcaatctcaacaccaaatgcaacgtagactctttctgaatgttataatcagacagcgttctaccgtcttccagttgcttaccagcaaaaatcaatctttgttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatgttgtagtcagacaaggttctaccatcttctagctgcttaccggcaaagatcaacctctgttgatccggagggataccttccttgtcctggattttcgacttaacgttatcgatcgtgtcggaggattcaacctctaaagtgatggttttaccggtcaaagtcttaacaaagatctgcataccacctcttagccttagcacaagatgtaaggtggactccttctgaatgttgtaatcagacagcgttctaccgtcttctagctgcttaccggcaaagatcaatctttgttgatctggagggataccttccttgtcttgaattttcgacttaacgttgtcgatggtatcggaagattcaacttccaatgttatggttttaccggtcaaagtcttgacgaaaatctgcataatctattagttaaagtaaagtgggagggagagttcgagagttcttgtcgtattgtagtagatagaagatatacttatccttatccgtacagttcttgctctttctgaagtagcactttcggaagaagaaagataagcaggcgaattcaaaggtggcaaaacccggagcctctctatatatacccccaaaaggaggaaccgccctcaaatgacactgaattctaaaaacaactgataagtggcatcgcccctgaaaaaagaaacgaagtggggtaaccaccgtgtgtggccggatgtacggctgtgtgatgctccactgggcggctatttttttttttggtaccgaaattggtttatccaggattattctagaacgttctagaaacaatactgaccacaaagacttttcggaatagaatattgtcaaacaagaactttttcactttcttttcataaaacgtcactttcatcacttttgcaggatttcccacagttcgtttaaagggacatttcctatcatgggttgccctgcgcgaataagatgattggtcaaggaagactctaaaatcatctgaacgggttatttgaagacttgggtctaaatgagagcttgcttattccacccgccacgccgggcgtatcttcactgtcttcttcggccaggggatccaaagagaatcgggcatattcgtgcgtattccttgtccgttgtctctggaaatctaagctagtgctggtggtgggaggctttgctttcttttctaagctttgtcgcgtgagctcgcttctcatttcctccagcttcaaatggctattgtccgtggacttcctgcccggagtcgatatgcttgagcggaattgtattacatccttgcgttgtttttctagtaacccgtcgtcttgcagcagccccagaacgttcctgcttagcttttgaatatcttccgccttacgttcatcccgaggatcctgaacctgaaaatcctccaggatctcaattagtatcatgtttcctttcagccacttgatgaattcattggacccgttattcatcagatatgagaccaaagtcagcgtcttcatcacctggatacaatttcgatgagaatttcttctgttctgcccaagtagcaatcgcttccggattacctggatgatttctcgtactgtcttggggctgtaggtcaagattgatatttcgttcataagcgtccccgttgctccacttgtttcgtcctcgttggtagcctgtttcacctttgattccgtcggtgattgaataaaactcttgaaggtatctaacaaaggcatcacgaccccctcactatatgtgtactcgttctttgacacctttatgctttctaggcttattcaacacataacctcaattttcgttttctcattcttttttctttttttttttttctcactaaagcgttgtcctagagatgtaaaaagagaaggaaatgaaatttttactggaaatgttactactattacacaggtttatttagaaagtacaaacgtgtcagcgtatttagggtgtcaatgcaacaatattgaaactatcatttgtcttcagaatagcggcaataccaccatctccgcataccacgtccatatcagtgaaatcggcagtgtcgctttgcaaacagagggcgctctcctcgtctttagtccaattttttgttttcttgtcaaatttgtatatcgtcagcgaattgctctcgtttgagtatgcaatcatattctttccagagtcgtcaatgtcataggtaacggtgcccgtcttgaattctgggattgtgtaagttggatacgctagcgtgccgacatcctttcttaggtcaaagcaaaccacagtttggtcacactctactaccatccagtacccattgtctgcaaatttaacctcttttatcttggcttcttcatctacggggaatctagagcttgcctggtcaggtgatgacaagttgtaaacgtctaatataccgtccggagagtaaagggctaataataatgaatccttatgtaggacaccgctgctgtactcaacatctgatttagcagaatgaacaatatactgggaatcatcctcgtaggattgaaatcctatggttcctctattatccgcccagatgaagtactctgtgttgacctcgttgtgaccatacatatatataatctcattggcggaatctacctctatttctctgaggactttgtttgtttttgagtccaatatagttatttggttacctggatatagtagtagcaaacgattacaaggccctctggaaataatagctggatgctctcccccggtacggggatttggtgtagttattgtggtaatcgttttcgaatcttttaattgggtaaaatgtaaagcaccatcctcacagcgacacatgcacacccatttatcatagtacatagatttgttaagctctttatatgggaatgttttgatgttacgggagtaattttgtgcctgtaatagctccaaattttttaaaatcggccatttgggtgctttgagcttgcccctcgctacaaagtctctagaagattgtaacagcccttgtaaaaattcttctctcgtaatagctaccgcttgctgtgaggatttgggtaaatccttcgaatcttcgtttttttccatcaatagttgcgcagcgaccaactttgcagcatctctttcgtacattacagtcgacagttttttcgttaaactatctagagttgatcgtaacttaaagttttcgagcattatagcatcccattcattctgtaaacttgtcaacagattcggaatcgaataattcgcttttaacgtagcagagtttgtagactctgttagtgaggcttgttgcgcactaggtacgatttccactatttcttcgatgcttaagggctcatttgttatcggatcattccccgtatctttaacatactgttcaaggagcgacttttcaaaaatagtcctggatttaggtgatagaactggccttctaggaactttcccactaatagcacaaagcattgttccctagttggctttcttggctatgttttggtctttaatatttcttggaaagtttgcatctttctaaaattgcccttacgaatttttcaccgctgctacccgaaaaagtacgaaatttatcaacatgaaatttattcctgccaagtcatcgagtgctctgcgcctaaggcttaggttgcatttaagttgtcttaattcacgcttatagtgcaggtagtataggttccccactcctgatctttcccttctgaaataaggaaagactgcagtttagtttggcagagagaagaagataatcatttctattatattctaccgctatggtgatagattccaaacaggatctacctcaatataccaaagattcaggttcagaatcggactcagactcaagtaataatttcattgtggaatctccgtcaattccatcttcaaaaagtgcaaccgtagttctcaatagtgaagagtatgaggacgacgaaggtgatgacttgaacgggctggatgctgaattgatcgataatataacgtatgaaggagatgaagatgaaactatgtttgtggggttgaaagaaaaacagaagttacatttatctggtgttttccggctgcaagtggtgaaaggaggtattgtctacaacaatgtacactataacgcttcgagagaaattttaaccttctggcacccgttatcacagtccatacctactatagatttttcgcactttgcaggctggcaagacactttttttatgccgagaaacaacaggtttaaaattagagatgaagaattcaaatcatttccatgtgttcttcgcgtttttaattctaatcatacgggcttgttagaagcaggtcatttatatcgggatgttaattatctatggaaacctaaagaaccttactttccattaaacgagagaacaacgtatcatttattacatgagtcagaccgaattcaatctttatccgtgccgggatattggtcaactccgttagagaagttatatttgagtcacaagaacgctgcgtatgatacaagaatcatggtgattggtggtaaaaactctgggaagtctacattcttgaggcttttattggaaaaatttacgcaagatatacgagattctactacgagccaggaagaattggtatacctggatttagatcctggtcaacctgaatactcactacctgattcaatatccctgaataagattctttccagccctatttctctcggacaacatctctgccaaggttcaaatttccaaactttgttacagttctacgctggctcctcttccccgcaggacgagcccacatcatacctgaactgcgctgataaacttatagaccatttggaagagcaagccttcttcggaacgtcattgcttaatctacctgggtggataaaaggattcgggatgcagattttaaatcatataataaggaaatataagcccactcacttattgtttttggaaacagctaattcgaaaagacacctggatgaactaacaattccacagagtttttccacatcactacgagatgcatatgcacctgaagttgttcgcgttccagcccatagtctgaaccacaccttatcttctaggttccatgcatcacaactgagaacattcaaaatactggcactgtttcataaaataactcaatttgattatgattttgcgcctcttttaaaatctgcacctttgcaaatttcatatggcaaaggtaaaagcggtattaaaggcattcaatttcctatggaattccaggatctgaatcctcaagatatcaagtccgcattggaaggtactgtcattgggatatatacatattctggagaagactcactagaggtgaaatccttgaatacctttcccatcctacaatcgtgtacttcttcttctaaaaatttcataactctggggctgatacactctattgacacctcccagcaaataatgaacatttacgtgccaccttgccatacccagattttagataaacaacctgaggatgctcaatggataatagtaagaaataagacggaaactcctttttgtgactttcttccatccccccgcacaattacatgggatgataatatacaaataccgttcgcaacttttgaaagaaggaaaaaattggaacatgtgtggaaagttcgtaagaacgtcatgagacgtggccaattcatgaaaagatagaaagaaaaggtaatcgtacattttttaatagtgaaagatagaggatacacaaaaatcatgcaaagttttatatatttgttatgtatactcatattccttcaatatctaagtcatactaacttctagggactttaccaaaatattatttataaatttattgtttcatttcttccgcatccttcatctcctccgttaaacccattttcttatttaatctatcatatttcagtctatctttatcgctcacagagggtttaatctttcttaatgcacttcggaagtcagacatggtcacaataatttcttcgccagatacgccaaccgatagatcctcaaattccttgtctaagtcattatcaagaacagattgtatttcttcgctctgaaaaaacttcctttttagagccaagactgaactctccctgactaaagcagccaagtcagcgcctgaaaaattgttgcacttctcatttctgataatttcttcaaaatcaacatcgctactcagaggtgttccgtgtgatttggtcaaagttttgataatatctagtttttcctcagtattaggtaactcaataaacaaactcttatccaatctgcccggtcttaacatagcaggatcaatcatatcaggtctattagtggcgccaatcacaaaaattccccttctatcgttcagcccatctaattccgttaacaaagtgttgacgactcttgaggaggattcggacaaagaagtatctcttcttggcaccaaagcgtccagttcatcaaaaaatataacacacggtacagacgcccttgctctagtaaaaacttgtctgatggacctttctgattcaccaacgtatttatttaataattcaggacctttgattgatatgaaatttgcacgagattcattggcaacagcttttgctagtaacgttttaccacaacctggtggtccccacaataaaacaccaccaggggcgctaattcccactttttcataaagctctggtctcttgatgggttgcacaatagccatatttaattcaagtctaactctttgcaatgcgcctacattagcccaagtaacatcaggtaccgtagcgaacccttctctctttgctgttggttgaattgttggcaacgctttcaaaaaatcttcgtacttaatcgataataatgataactgctctcctgataaaggctcaggataattacgaataaattgttggactacggataaaggcaacggatcgatcatattcgcagtgttcttcaggctagattcatctccgtttgctgtttcatcaatttccatgttatcttctgaactgtccgttgccgtagttggtgtggattttatattagcataggtttggaaaattcttttaatagcgcatgtaccggcagcagtaactaaagcctttaaatcagcgccaacaaagcctggggttaattttgccaatttggcaaaatcgatagcaccatcaatttttaggttatcagacattttctttaaaatatgtaaccttgagacttcattcgggacattcaggcatatttctctatcgaatctacctgctcttctcaatgctgcatccaaagagtcaggtctattcgtggcacctatgataataacaggttttccatttgtcttttccatcgttaattcatccattgaggtcaataattgggcaactattcttctctccatttctctttgggctcctccatcacgttttggtgtaatggcatctatttcatcaaagaaaacaagacatggtgccaagcttctcgcttcatcaaacaaatccctaatctttttctcgctttccccagacataccacttacgactgaaggtgcagaaatagatataaatgggacttgtaattctccagctaacgcattagcaatcgacgtcttaccgcaacccggtgggccatgcaacagaacacctctaggtggttcgacacccgtggataaaaatatctctggatgaagaatgggtagacctattagttccataagttgtgcaacgacatcatccataccacctaaggatttcagagacgaattaggtggagatctatcttccttgattttttgacgttttaccttacatgtaccttctttggatctttttttagattttttaacctcttctgtcttaggatcatcagtttctgttatagactcggaaacagatccagatttggaccacgtgctagttatgcgtttgttcatctcatttgtgtctcgctcaatcatcatatttttcttagctagttcttcttccaagcttggtttctcttcctcttcgttgttgtaacctgggtaagaaccaaattcttccaattctgattcaatcacgtcttttagcatgcggtcaattgtcttttgtaagacaactttcttaactctttgaagtgataaatctttagtcaaacaaaaggtaaaaatctcacctgctgttaaatctttagcgaaaaacatggattcaaatatatcctcatcttcttcaccctcgttgttctcgccctcttctccttgggattcttgtctcagagacctttttctgtccaaagttttttcttccaagagacgatagataagatcgacgatcttgttatctagagaacttgttaatgagttctttttcgactttactttaaccattattccagccttcccaccacgtagctattatcggccctaatgatcttttattctaactgactcgcagattaattcacacatcggttgttaatcattgtttgaatttccaaaatatgcgatgagctgaatgaaaaattttggaacctgtcactatcgacgaacatcgaagtttgccatgacaaccatatatgaagaaagcttatgagactagctcgagtatatcatacgtatgcatgttaatcgcagttaagcggataacacaatgcgtaagccttctattacgataacaacagcaaaagctattataactccagactatactcttattaaatcgcattctaaataccaacttccttcacgttttcaaaagctagatgcagactcacctgagagaagtacagttgttaagctattttaccgccgatttatgaggcttaagcctttcatatcgaatgtgaaaatggttaaagatacttacagggattatgttcgatataagtttatgaaagaaaactacgaactcaaacgatacttggtattcaatcctgatggcttgaggtcgaaaatcaatcttgagcttctcagcaacacgaaatgttgtgaaaggatactccccgtgactgagatgcaaagaaccttggaatttgttctgaagagctgttcatacttgcccgaaacaaaagttcaaaagtgggatattgcaagggacaacacatattgcaggcaaattttaaagaaccttttaacaatgcaatatgaaaagtacagatcgattttgcatagaggaataggccatgatgagcttgacgtcaaattctctcatttgaaaactacttctagtccgctaactaagctaaataaaaccgaaaagaaaaagattccgcttttcaaagtatttagtgatttcgatacaacattgatatatctcaatgagacattaggtacaaggttataaagatcattatcgtaaaagaggagcggagcggagctttttagtatgtatggtaaaatatcaatcaaatactgtaatagatgcggatatgcgcaatgacatattttgtggtgtgcatatccattgaaaaggtgcgtagaacgttacaatactactgaacttttttccttctcattttctgccattttgatatttatgcctattattggtttgagctttattagagttggcataattataatcgtactcgtatgtatatccgtatccatacccatatccgttgtaataagtgtttggtatatatcctttgatggcttgggctcctcctaccgtcgttataacaggcattttgtggcgttgtggtgaggctcctgattggctggtattatcgatggtcgtacgacttttggcattattcattgatctgaaattgccattggtattgctattactggtgttactcttgctggaggcagaccctagaacaaattttttaattatttttttaaatattattttcgtcttttgtgtttccaaataattggatagtaattcgattgcttttgttagagtattctcattagtatccttttcaaaagtaaaagtgataaggtccttctcaaaagttacaattatgttcataatttgcaaaaatggaacaacaattaggttataaaattcgtattctttattgggatctatctcttgatctattttgaactcgtattcataaccaaacgcactattaaccaattcgttagcggctcttgatgcattctcatcatttccttgtatactcaattgagatgttccatccaagggctcttttaacggtatcattatgtaaacattttcgttcttttcgatttgtcctataatattcttttggccgttaacatgcaaaatatgtctatattgcccactagaaaatctaatgagcgtcttcgattgtaaactatcatattcttgaacaatttgttttaaatcattcttggctaggcatatattagctttgtttttcctggggcacctaattatcacattatcatacctgatcatagaaattttattttgtggaagattgaaactattggaaaactgaatgaagacgttatgctttctcattgtggcttgaattaaggaaccacctgtacctataatcggtctgtgacaaacttcaggaatgaagaaagattcttcggcaggaaattcatttataacattcttaaatgattccttgaaatcagggaaagagtcactaaccaaatttaaataaaggttatcatcttcctcttccatttccagttgaattaagcaagcagatagttccattatacgtgttaatttaccatttttcttgcctgatatgaagtcttcaaaatcaggatgtatctcgaaaatggcttttatctgtcttaagtttggattaatcacttgatttgagcccataataaaatcagataagtaatgcaatatggaagtatcggacgcctcatctgtggaagattggttaccaactactattaattggttgaaggaatcctctttgggagttattactacaatttggtttccagtgtgtccgaaaaagctgtcgattattaattccggggacattgcgcagttttcattgagtgaaatctgtacttctacaatttcatgtaatacttgaatagtgaagttcttaataaccatttctaataagttcgtggaaatcgattgaaattcaatgtattcgttagtaactctaataagcgattggtatttcaaaattaactggtttaccttttgttggtagtattttcggataaacagtagttttcctggggtaatattagtcaatcgacgataaaaaaaactctttgaattcacgcttatggactcacgtagagttttcctagccagtaaacttagtgaatggacagcgcctgagaagaagatttgtggatttgccttaagatccctagacagcgtaatgagggaaggtgcgtaaatgctggttttaaaagctctggatatatgtttgaagttttccatatctacacccatatataagggaagcacagagtatgagttcagttccataggttcgataatgtagtgttgtggaggcaaagtcataccattcttctttattaaatcgacaaatgccaataactggggttcgcattccattaaattagatcggaatcctaatgcatgcacgtaaatacataattccttgctctcgcctgtctgttctggtgtgaagtaagctggttctttggtgatgattagttctaaattgaatttttcactcaagtccaatagtatacgtttcattttttccaattctgctgttagatcatttgtgttcataggtaagggcaaagaaatcctgcaaatagcatcgaggtccatatcatctgtggtagcttttattgagatcatgtcatctctaatgaaagaagcatttagattgacccatgagggatctatatgacagattgcttttgtgtttttaagttctttggagcttattcttttttgaagaaattcaactaaaaaaggtgcttctatgggcttccataatctatttgtcgtgtataagtgtggaacttgtaaaaaagcagttgtgataactgtactgtaaattttgaagttatccatgcctcaaccgtgtgtttactgctgtttttctttttaaacaattgtgtagacttaacctctgcgggcttgaatagtgcttcaaaaggttcaggtagtcaagaggttagctatataaacaaagatgacttttcatcctttatttcttttattttgtttttgttttttgcctttgtggaaaaaaaacaatctacaagcgaaaagaaaaattttggagaaaaatataatttaggattacaagaaagtgatagaaaaatgtacaatcttaaaagaataaagctgcagaaaagagatgcttttgctttcaaatttttgcaatatcaagagatatgatttacttgtatctaaattacatgtagatatatatatatagtatatttgtaagtaaagagtggaaatgaagttcgtcatttccaaaaaatgtcatttatgtgcttaatcaatctcccactagcaaatgcaattgtaccaaaagtaacgaccagttgagtgactattaaacttaaagaagcaaagataaaccttgggcagaagattttccaaaccatcaagtgtctacggaagtgagtaacccaaataaaggagcttagacataaaatagtattgtaagtgagtaatataccgcagtttgacacaattcttcctaaaagtgtttgtggcttcaacacatcaggaggctgtgaccacagtgtcagtaacgctacagataaggagacgagaatatgaggcccaaatgtatttaggatgatggctatctgagtgaaggggaacgttaccttttcagacagcataaatccgatatcccattgcactgatggaattgtggcttgatgaccggtggtgaaaaaatgttggtaagataagagtcccaacgcaattggaccaattatgttttcctttaattttaaaagatcgataatttctaaaattgatagtagttggttgcacatgaggaagtatgacaactgggccaggggtttgttgaatagtaggatactaatgagaacgtttatgaccaaaagaaaaaactctgagccgtaaatattagtataacctaaaattgttgcttcgtgagacttaacatcagtattatgaatgtttaatttaatacaaagtggtcccattagccagccgacattagaagcaatcaatgaaaaaccggcaataattctagccaacgtaaatttaaaaatagtgacgtcccgtaagaacggtattgctattaccgcactgttattttctaatgaagtcaatgaccaataaacaaagttcaaaccaaggataccctttaggaaaacgtttatccaaattggagctgcagcttgataagacgatgttagattataataaccggtgatgcatgcaggtaatatgaatatcattaggaaacagagacccaaaacccaccacgaggaattgttttgattattaaatgttggaatacaatattcgccttgttcctctctacaaatggtaatcatagaagctaaccgggtaaaaatgattaaaactgcagaatggtaacctcctagtaatcttgcaaatcttgttaatggtaagtaatttgaatttgctgtcgaaggattgacccctgaagtggttccttccttttcactgattgttgcagttaataatgcagtggtggattgcctttttggtaagaagacaaattcatacaacgtcaacatgccgaaagtagataaaaggaatgctacaattctatcctcccaaatagtaaatgaattggaagtgaaaagcaaagcatgaataatcataaacatgacagcaattcttgaccaataatcagctaatgtttcacccagtctcatagcaatccaaataaagttgtacctatcaaatattgtgatataacaaccaataatgataccaattgcagtcgctaacagggtaccccagaattggtctacaaaacttggttgttgataaacgtaaaaaattccatggaaacataggtttgtaactaagaccattatgataattcccggaacgaattctggaaccatttgattcacaacaatagaaggaattaattttgtaatggatatcaacaggaccagtgaagtggccagtagcgttataccggtggcaatggaataataatcgaatttggcccatagttcttcgcaggtctgcaagaagaccttttggtatttatgacccagcttaacaaatttttctggatcgcttgttgggggggtgttagatatatttttcgctaacggttccaatatttcgtcattgccatggtggatctgcatcgtgtccttatataattgtaattggcttatcgctgagttgacaaattgagaccattctctatcgtttcttgctatttcgtcaataggccatccaagattgttaaatggtatcggttggcccatcaataacgccaaactagacaccaaatcaatttgtctcactgaacggtaatcgtgtcccaaattatcaatgttgtaattcgaagtttctttaagtctccacatgtccggcttcttagaataaagaaataaagtgctttcgagctcgtcgatggagtcgccaccgtgattgcccgtatggtccattccatggtcacccaaaataaccaataaggtatcatcatcgatcgattttagtatccaatcgataaattgatctacttgaatttgtttttccctcatagtaaaatggtcggggccatatttgtggcccacatggtcaatacctagcatgtgtccaatcatgacgtcccattccttgtcctgctgtaaatgatcatggaagtaatccataacaccgttatcgacagtatctaagtcccacacattgagtgattctagtgggaaactatcgttggaaaggaacggatggaacagagccatccatgtatcatctccggcaaatttgacagtcttatttgccaaatggagctgtttaagaaagttatcctcttcgattactgttccatcgaagttagacccggcatcaatgaaagtcggtaaggaccctgttgtgagacccttgagtctttgtaaagtagtggttggtgggtcggcaatgaacttcaacaatagggaagatgcatccttatcgcttgcaaaagaatcatacaatgataatatattattatgatagttcaagttgtaattagagtgggattcgtttacaggaatagcgaaatcaaatctcaaagcgtcaataaccaaaatcaccgccttgttgaacctaggaggtaacttactcgtttcgttttgtgaggaaatattatcaagaacgtgtcttgacagtaagaatccccgagtgaaaaaagctattgatatgaattgtaaaatggcgatgaaaaccaatagaataatataaaatttatgattcttttgaaatttctttattcgcgatttgtatattattttttcatcattggaagatgaaagaatcgactttttaattgtcttttcatccatattacgggagctttttttttccacttaatgtattgatcttcctcccgttctttgacgattcggcgttgcccttaaaacatatgcttctattccttttttgatcttacccatttatttgtttttttttattttccggtggacaacaaaatgttaaaggaaaaaagaaagtaccttgctcgtcatcgcgcttgcataatgtgcgccattaccctgtaacaaaaacaaaagatagagtggcaacaacttgacacaactttgcaattgtaccatgaaccccaacaagaaaggcggttgagagtaaatgatgtggtttggttccttttttttcctacatttaaggttcatagagaagaaaattttctgaaatgtcttttcctcttttaatgaattgtaaaaaagccagtattggaataatattctattcaatatagtaagaaaagaggcaatgggcagaaatcttctcccgcataatcctttaaatgcaaaatacatgttaggcgtctaaatttttttcagtgaatccagatgcagaaacatttaaacaataaatatcttaaacccattttgaagcatcggcggctaaaaaaatgattttgcatggaaaaaaatgagagctgtgaacccaataaaaaagacagctttttaaaaatgtataacggtacattaagctcttgtttattcctcaaactgctcctaaaaaccatcctctcaaaaataataatgatagctgaagattatctgccacgaaatgccattgagccgcttacttgtaggttttcatgagtaataacgaagataatttacccgtctttataacccacgtaaaaataaacatataattatttcttattatttcaactaaccgttaaagtgttcaaatatggtagaaagctttccctatgtgcattatgattatcttttagccgccagagtttagtttaattttgttttgtttttgacgacttctggtgttacccgaaggtatatccccgggtgacccctaaaaatcgcaccccattttcccgaattttcttctacgttttcttttttcagaaatacttcgaatgagggatggaacaagaaggaagcgacatacaaaaactgagtcagtttagtcttaataggtgcaatatttacaaatacaggaaaggcaggaagcactggcaaaaagactgcatagctaaaaaaaaaaagaataaaaaaaaaacggagacctcaacagagcgaaaccaataattacaaacaaaatcttcatatgacttcgaaaccatccaccagtgacggcagggctcactcgatttcccatgtacctggcacgcacatgagaggaacatcggcatcacacagccccagaccgtttaggccatgtgcggattgtacgtgttctccaggcttactgtctaggcaaggtcgtagagcctctctatttttaagacagttagaaaattcaaggaggtcctccagcatgcttctcaacgagttgaagggcgctggcggaggtagcagtgctggaaatgggtctgtttactcatgtgactctctatgcgctgttaacagggaagttaacactactgatagattgttgaagttgcgtcaggagatgaagaaacacgatttgtgttgttatattgtgcccagttgtgacgaacatcagtccgaatatgtatcattgcgagatcaaaggcgcgccttcatttcagggttttccggatcggccggtgtagcctgtatcaccagagacttgttaaatttcaacgatgaccatccggatgggaaatccattttgagtactgatggaagatatttcaatcaagctagacaagaactagattataattggacacttttgaggcaaaacgaagacccaatcacttggcaagaatggtgtgtcagagaagctttggaaatggccaagggacttggcaataaagagggaatggtgttgaagataggtattgacccaaaacttatcactttcaacgactatgtttcttttagaaaaatgattgacactaaatatgacgcaaagggtaaagtggagctggttcccgtggaggaaaacttagttgacagtatttggcctgattttgaaactctacctgaaaggccttgtaacgatttactactgttaaaatacgagtttcatggtgaagaattcaaagacaagaaggaaaagttactgaaaaagctgaatgataaggcttcctctgcgacgaccggtaggaatactttcatagtagttgcgttggatgaaatttgttggttgttgaacttgcgtggatccgacattgactataatccagtttttttctcctacgtggctattaacgaagacgaaaccattcttttcaccaataaccccttcaatgatgacatatcggaatattttaagataaacggtattgaagtcagaccttacgaacagatatgggaacatttaacaaagataacttcgcaggcttcttctgcggagcatgaatttttgattcctgatagtgcatcgtggcagatggttcgttgtttgaacacctcaaccaacgctaacggtgcaatagctaaaaaaatgactgcacaaaactttgcgataattcactcacccatcgatgttttgaaatctatcaagaatgacatcgaaataaaaaacgcacacaaggcgcaggtcaaagacgcagtatgtttagtgcagtattttgcatggctggagcagcaattagtggggcgcgaggcactgatagatgaatatcgtgccgcagaaaaattgaccgagattaggaaaacccaaaggaacttcatgggcaattccttcgaaacaatatcctccacaggtagtaacgccgccatcatacattattcgccgcccgtagagaactcttcgatgattgatcctaccaagatatatctttgcgactccggttcgcaattcttggagggtacaactgatataacaagaacaattcacttaacaaagccaaccaaagaagaaatggataattacacactggtacttaaaggtggcttagccctagagaggttgatttttcccgaaaacactcccgggtttaatatcgacgccatcgctaggcagtttttatggtcccgcgggttagattacaaacatggcacaggccatggtatcggatcatttttaaacgttcacgaaggacccatgggtgtcggctttaggccacatctgatgaatttccccttaagagcgggtaacataataagtaacgaaccaggttattataaggatggtgagtatggtatcaggattgaaagcgacatgttaatcaagaaggccactgagaagggtaacttcttgaaattcgaaaacatgactgtggttccctattgcaggaagttgatcaatactaagttactaaacgaagaagaaaaaacacagattaacgagtaccacgcaagggtatggaggacaatagtgcattttctgcagcctcagagtatttcatacaagtggctgaaaagagaaacaagcccactatgacttcgaggcgagcggggcgcaatacaattaatgttagtatttattctaagtagtttctttctttttatttaatttgagtgataacaataacaacaataatgactaaaaggtgaaaattgaaaacattaccttcatttttttacggccggagaggggtaggtacacttaaccccgagcgcttttagtgccaaaaagagttaatgtgcgtagtcggattttaaacgaccatgcatgtacagccccctagtgatttatactgatgcctcatcaagaaattttttcatccagggtccctgctcggcgaacctttccgcaagagtcacaaaaatcaatcttataaccaggcaccagtagtactgccaagcttggactacatagccaacgtaaagacaaggagtctgatttagtatttcttttttgccagccagtattttctgcgcaggatagattattttaagagccgagaattccttatgcgggcccggtcacaacggattataggttccgccagaccccgttgctttggttccatggagcaggagcaggattttccgtggaaagagaagcaccgagcgaaaagcggatacggaaggcggatgcggaaacggatgcggacgcggaaggaaggaaggaagcaaacccttccgtctatgtcgctatgaagccgtctcacagtagagccattcgagatttccgtccgtcggtacacagaaatcttcgtatcgggagttttactttaaaaggaaacgatcgtaggaattccctaaagaaaaaggaagaaaaatttaacgttgaacattgtcattttcttttttttttttatgtgtgcagaatatactatcaagtaatgtgttctatatataaagggtacctcatttgatcttgatgtttctttctgctcgtatgccttgagtcaccagttttcaaaaataatcttggtctatagaagagaaaaatccaataatctgaaattggttcttcgcacccttgcaacgagatcatatactaaatatcgggaactctttatttctggatcttttatcagtcacttttttttttagtcaaagaagcaagagaaaactagacagagacaatgtcggatcattctcccatttctaataaggaaaatcatctgctgccatcagactcgtcaagaagctcatccagcgatatgcattcgacgggcaccacgggaaccacaggcgtcgaacctgtagatttcaccggtgaaggtgccaaatacacaactgctacggagggcaatggtggtgcagatttagcgattcaaagaacgacgactatgaattctgctgcagaatcagaggttaatatcacgagaagattaactaaaatccttactgggtctgttaacgagcctgaccgtgtagaggttgattataccaattgtgcgcccatgggtggtgacagaccttaccctccatcgttgccgagcagagacctgtacgaggttacttttgatggtcctaacgacccactacatccatttaactggcccatgaagaagaaagtgctgctatgtctggtcttatgtctggattctattgccattgctatgtgttcttccatttttgcctctgcagtgccgcaaatctgcgagatataccacgtcatcgaagttgtcgccattttgggtatcacgctttttgttcttgggtttgcggcctcaccggttatctatgctcctctttctgaattgtacggtagaaagggtgttctggttttatctgcgtttggatttgcccttttccaatttgctgtcgctactgctgagaacctgcaaactattttcatatgtagattctttggtggttttatcggggcagcacccatggccgtcgtccccgccgcgtttgccgacatgtttgatactaatgttagaggtaaagccattgcgctattttctctaggtgtttttgtaggccccattttatcgcctgtcatgggttcttatatcgcacaaagaactacctggagatggttagaatatgttgtcggttgtttcgcttccgcagttttcgttgccatcgtattgttctttgaagaaacacatcaccctaccattttggttaacaaggccaaacagatgagaaagcaaagtaataactggggtattcatgctgctcatgaagacgtggagctatccatcaaagacattgtccaaaaaactgtgacgaggcctatcattatgcttttcgtggaaccattgctactattcgtgactatttacaactcttttgtctacggtatcttgtatttgttactggaagcctacccacttgtctttgtggagggttatgggtttactgaaaacggtgagttgccatacatcgccttgattatcggtatgatggtgtgtgctgctttcatttggtatatggacaacgattatttgaaaagatgtagagccaaggggaaattagtgcccgaggccagattgtacgcaatggtcattgcaggtaccgttttccctattggtatcttatggttctgttggacgggctactatcctcacaagattcattggatggtccccacagtaggaggggccttcatcgggttcggtttaatgggtattttcttgccatgtttaaactatatcattgaatcgtatctattgttggcagcttctgccgtcgcagcaaacactttcatgaggtctgcatttggtgcatgcttcccattgtttgcaggatatatgttccgtggcatgggtatcggttgggctggtttgttattaggtctatttgccgctgcgatgattcccgtgcctttactattcttaaaatatggtgaatctatcagaaagaaatccaagtatgcttacgccgcttaagaaaaagaaaagcagaaatcatgctctttctatatttgcatttttttatttcattgttattactcaccctgccccacgctcaaagggctcgataacgacatagcattatagacactgtgcagcgtaaagctgacatataaagaaattacaaaaaaaaattaaaaaaaaaaaaaaacaatcaaaaaagacacacaactacagaacaaaggaaatctttttctatgcacaagcacaagagtacttagagagtagtgatatccccttttttttctactatttttttttttcccatttttttcctccaagactcctcttatgtggttgttatgtatagcccatagttactaaataaaacactaattaatgattaataatccctctctaataagaaatagataaaagctattgttcttctcatcgccggttctcggcgttgtccgtacccttggccgaaactcgggcgggggcttattagtcataccctcagatttcattggtcagataacagtcacccggtaaatgcccgtttaatgacttctttattttggattaaaattgacagggaatttcaacggaataaaggaaagagattgagatgcttttaattcataaaggaaagggaaagaggacaggaaagcaaggaagagtaatggaattttgcaaatatttgtaaatcctttagaattactaagaaactgttatttattgacattattttactcgtcttatttatttatttatacatttggccaccatttttgcactcgtacgaaagaccattttagatttttttgatttggtagtataacaaacgatcggaacaataacgtaacataatgataaacacaggaagaagcaggaattcagtactgctggcacacagattcctttcaactggaggattttggcgaggcggtacgaatggcacaatgtctcgcacaatcaacaacgtaaatcctttcaaattaaaattcataccgaagacagtgcccgcagctgcagactctgtctctccagatagtcaacgtccaggtaagaagcccttcaaattcatagtttccaatcagagcaagagtagcaaggcttctaaaagcccgaagtggtcgagctacgcattcccttcgcgtgagaccatcaaatctcatgaggaggccatcaagaagcagaataaagctatagacgagcaaatagctgctgcagtatccaagaatgactgctcttgcacagaacctcccaagaaaagaaagaggaaattgagaccaagaaaggcgctgatcaccctgagtccgaaggcaatcaagcatttaagggcactgctagctcagccggaacctaaattgattagagttagcgctagaaaccgtggatgttcaggactaacgtacgatctacaatatatcaccgagccggggaaattcgatgaggtagtagaacaagatggcgttaaaattgtcatcgattcaaaggcgttattcagcatcattggaagtgaaatggactggatcgacgacaagttggcctctaagtttgtcttcaagaatccaaactccaagggcacatgcggttgtggcgagagtttcatggtttaaaaaccttctgcaccatttttagaaaaaaagaatctacctattcacttatttattcatttacttatttatttacatatttatcatacatattaacattgaaccctccatcgtggtagtgtttgctgttcctaacttttctttcgttgttcttgtagatatatatttttccagaattttctagaagggttattaattacaatcttaaacgttccataaggggccgcgatttttttgttcaattttcaacagggggcccatctcaaagaactgcaaattatatcacagtaaaaggcaaaggggcgcaaacttatgcaacctgccagattattatataaggcattgtaatcttgcctcaattccttcataattcgttcctttgtcacttgttcctttttacccttgaatcgaatcagcaataacaaagaaaaaagaaatcaactacacgtaccataaaatatacagaatatatgaacgaccaaacgcaatttacagaaagggctctaacgattttgacgttggctcaaaaattggcttcggatcatcaacatccacaattacaacctatacatattctagctgccttcattgaaacgccagaagatggatcagtcccttacctacagaatctaattgagaagggccgttacgactatgatcttttcaagaaagtggttaatagaaatctagtaagaattcctcaacagcaacctgcacctgcggagataactccaagttatgctttggggaaagtccttcaagacgctgctaagattcaaaaacaacagaaggactcatttatagcgcaagaccatatattgtttgctctattcaatgattcgtctattcagcaaatatttaaggaagctcaagtagatattgaggccatcaagcaacaagctcttgaacttcgtggtaacactagaattgactctcgtggcgctgatacgaacacacctttggaatatttatcaaagtacgccattgatatgactgagcaggctcgtcaaggtaaacttgaccctgtcatcggccgtgaagaagaaataagaagcactattagagttttagcaagaagaattaagtccaacccatgtttaattggtgagccaggtatcggtaagaccgctattattgaaggtgttgctcaaagaatcattgacgatgacgttcccactatcttacaaggcgctaaattgttcagtctagatttggccgcattaaccgcaggtgctaaatacaaaggtgatttcgaagaaagattcaaaggtgttttgaaggaaatcgaagaatcaaagactctaattgtgttattcattgatgaaattcacatgttaatgggtaatggtaaggacgacgctgctaacatcttgaagccagctttgtccagaggccaattgaaggtcatcggtgccaccaccaataacgaatatagatctattgtggaaaaggatggtgcctttgaaagaagattccagaaaattgaagtcgctgaaccaagtgtgagacaaacagtggccatattgagaggtctgcaaccaaagtatgaaatacatcatggtgtaaggattctggatagcgccttagtcactgctgctcaattagccaagcgttacttgccatatagaagattgccagattctgctttggatttagttgatatttcttgtgctggtgtcgccgtcgcaagagattctaagccagaagaattggattccaaggaacgtcaattgcaattgattcaagtagagataaaagctctagagagagatgaagatgccgactccaccactaaagatagattaaagttagctaggcagaaggaagcttcattgcaagaagaattggaacctctaagacaacgttacaatgaagaaaagcatggccatgaagaattgacacaagctaaaaagaaattggatgaactggaaaacaaggcccttgatgctgaacgtagatatgatactgctaccgccgctgatttaaggtacttcgccatcccagatatcaaaaagcaaatcgaaaagcttgaagatcaggttgctgaggaagagagacgtgctggtgccaactccatgatccaaaatgtggtcgattcagacaccatttctgaaacagctgcaagattgactggtatccctgttaagaagttgtcagaatctgaaaatgaaaaattgattcatatggaacgtgacttatcatctgaagtcgtgggccaaatggatgccattaaagctgtttccaatgccgttagattgtctagatcaggtttagctaatccaaggcaaccagcatccttcttatttttaggtttgtccggttccggtaaaactgaattggctaaaaaagttgctggatttttgtttaatgatgaggacatgatgatcagggtcgattgttctgaattaagcgagaagtatgcggtctctaagttgttgggtaccacggcaggttatgtcgggtacgatgaaggtggctttttaactaaccaactgcaatacaaaccatactccgttttgttattcgatgaagtagaaaaggcacatcctgatgttttgactgtcatgctacaaatgttggatgacggtagaattacttctggtcaaggtaagacgatcgactgttccaattgtattgtcatcatgacttccaatctaggtgctgaatttatcaattctcaacaaggatcaaagatccaagaatctaccaagaatttggtcatgggtgctgttaggcaacatttcagaccagaatttttgaacagaatttctagtatagtcattttcaacaagctatctagaaaagctattcataagatcgtggatattcgtttgaaggaaattgaagagagattcgagcaaaatgataaacattacaagttgaatttaactcaagaggccaaggacttcttggccaaatatggttattccgatgatatgggtgcacgtccactgaacaggttaattcaaaacgaaattttgaacaaactggcactaaggatcttaaagaatgaaatcaaggataaggaaactgtcaatgtcgtcttgaagaagggtaaatctcgtgatgaaaatgttcctgaggaagctgaagaatgtctggaagttctaccaaatcacgaagctactataggggctgacacgttaggtgatgacgataatgaggacagtatggaaattgatgatgacctagattaatttaatatagtgtgatttttaaaaactttcgaacaagaatcagtaatataatatatataattaataaaactaatggaatttgtttaattgaacttgacacccgagcaaaagagctcacattttaacgtttagttcatcttgctgtgaataatctaaaagtaaacaatggacaaaaaagtccactggacgtcaaatctttttttattgtatttgggacatatggcgttgataactaaagtttaaaggaagtaataagtgaaggttaaatctggacctctttactttcatattagaagtataaaacacacgcggattggtccattattagaatacgggtactacaataatggttttgatagttactgtacatttgaatgtagcgactcatatgactcatatatatgactaccaaatcatgttaaaattagtatatctttaacttagacttcagtactatctgaactgcacgtttaaatttttaccatagcagttcatgtaatattaataatcacttgtgccaatataatgttacagcgaacatttttccatgcgcttggaaaattgaatgatagaaaattcgaacagcgatgatttccaacgatgtaatccattaagatgattgttagaatttctattgttgcagaggtcatatgatattaagaacacagcacaatatattaaaatttcttctcgaggatattgagaaatgggtgaattttgaggtaattgttgggattccattgttaataagggctataatattaggtatacagaatatactagatgttctcctcgaggatctacgaatcctcataatggaatcaatatttctatatactaatattacgattatccctcattccgttttatatgtttcattatcttattacattatcaatcctttcactacagcttcctctaacctcgatgacagcttctcataacctatgtcatcatctaacaccgtatatgataatatagtgatagttataactattagttgatagacgatagtggatttttattccaacagatataagaattacaaaaagagaactgttatttctacataataatattacgattagtactccttttatatgtttctttatccatttacattatcaatcctgattaaaattcccacgaacccccagtactagattgttcataatggatcaagttcacaagttaataagggcgtgtggtctagtggtatgattctcgctttgggcgacttcctgcctaaacaggaagacaaagcatgcgagaggccctgggttcaattcccagctcgcccctttattttctttttttggacccaaagcactagcttaggctgtccatctttgttcttgattctaaagatcacagtagaataatggtttatttcttagagttctacaagttttagcgtactactgaacaatgaatgtcctgattttttaaaactcgcgcatatttggaggccatatcgtgccaccaactttactacagtcaaacacctgtgcccaattctaccacttattaaacaattacttagtaagatcagcaagcggttcatctgtcccccattcatatatggctttcaccctctttacctgtttgaaacagaaaaaaaattacaactaatggtatgcaattcataaagcataggccaaaagaccctgatacagatatatgctaaaacaataattataaaggattatgccgtaggaaggctgagaatcctcagtttgtgcactttgaaattcaaaatacaaaaaactgttgacaaattagtatcataactatctatcgcatatattcacgtcacataccgcctctgtggcaattgacaacacttatccctatcaaagacaatacaaagtatttgttaccgagtgagattatttagtacaatatgtgggtaataaaaactaatcggagatatttttttacgttttttgatgcaaacgcaataaattcttgatttttgaaattttgcaggacatcaagatacgtttcttttaagcagtttggattgcttctttcgttccgaaagtaaaacgtaatgaaaacccctatagtattgtgacgcgttttccaactctgcccttagcttgatttgacggcttagaacaaaggaacagtagcacgaacacttcaagtgcaaatgacagtttaattgtgggtaaaaaaggtagcctcaaagttgcattttttatggactgtaaagaacatacgattgttatacacttttgaacaaccaagatgtactacctcaattgtagtgaattaatgtcgaaatttgttagatgccccgaataaatagtaactttatttagggaaagcactcgaatttttgttattacggtcacgccatattttagcatgtacttagtaaaagacccatttcgccatcactatttttaccatttttttctatacgatttgggagcaaatacctgaactgcacactaatggacataatcacttggttgaaaaagtactatagtagactatacgtcgtacgctgcaatctattttaagcacagaaagcatccttcgtatgataatataacctttttggtaacagagttaccattgaagcgacattgcagtgaaacttgtttcaagatgtagttgggaggaattatgtgttgagttcgtccactttatgagctcgaagataacgagaaaattgctaagatgccggtgttggcttcttgcatatgaagaggcaccaataaaacgatgcattaattctttattacggaagttccgaagcagcgaagaatgaaaaagaatacaagcgctcataattgtcctcggtggacatcatatacagcataaaagtgtcttttttaagttctctcccctaaagatcacaaacttcacgtaattagtaacgtgtagactactaaccttgaaaaaacgaaccccttttctgcctagcaaccgtttaagatataccaaaaaaggcaactgtgatgacttctgaacgagggtccacgccaagtcacgccaagtttgttttcggatcttctgctagcagaaactcaacacacctacatgaaaggtaaagggtttcttagaaacattcactgtaccgtgcattgttcaaacctgcgcgattgcttggcaacggcgagaattacattacaagaaggtgtgctttcataaacgagaagtaataaacttgtgtcgttcagaaacaatagtatctcatattggctacaatggagaaacttacgatgtgtattcagtatattggttagaaaactgtagtttgttagttgaaaaattaatataaatagggtgtttttaatcagctgtaatagaagtacatcctcatccttcttcttcactaagctcacatcatcactaaagcaacaaccaaaaaacaacaaatacaatggtcaaattaacttcaattgctgctggtgtcgccgctattgccgctggtgtcgccgctgcaccagctaccaccactttatctccatctgacgaaagagttaacctggttgaattaggtgtctacgtctctgatatcagagctcatttggctgaatactatatgttccaagccgctcatccaactgaaacttacccagttgaaattgctgaagctgttttcaactacggtgatttcaccactatgttgaccggtatccccgctgaccaagtcactagagtcatcactggtgtcccatggtactctaccagattgagaccagccatctccagcgctctatctgcagacggtatctacactgctgtaccaaactaggatttgacgcccttacgaatagaactttacgagtattagaatgttatgaataaatgaaattggtttcgacggtatagatgaataaaggtattttgaaaattataaaaaaaagttttaataatatagatttggtaaaataaataggcgtatatacacattgtatactgttgatattatcaagtttttattattaaagagctctttttattttttatttataggggaaaatgaccgatattcctagtcttcaagtcactattattttttttttattcataagtacaattgaataatattattgatttttttattattgttcttattctttttttatcatttctatataaaatattatatgatttagtttatcgtaaaaaaattaaaaaatacagaggaaagcaaaagtaaaacttttcggatattttacagggcgatcgctaagcttaatcaacttcttcgacagttggaccttcagcttctggagctggaggagcaccacctgggaaaccacctggagctgcgccttctggagcaccaccagcttggtacaatttagacatgattgggttggcaacctcttgcaattccttcaattggtcatcgaattcttccttggtagcagtggtgttgctgtctaaccaagcaatagtttcttcagccttcttagtgacagcgtccttgtcagcttgctctagcttgtcaccagcttcagaaatggtgttcnnnnnnnnnnttcaaagagtaagcaatggattccaattggttcttggaagcaattctttgagattccttttcatcttcttccttgaatttttcggcttcagcaaccatcttttcgatatcttccttggacaatctacccttgtcgttggtaatagtgatcttgttagacttaccagtacccttttcgacggcggaaacattcaaaataccgttagagtcgacatcgaaagtgacttcaatttgtgggacacctcttggagctggtggaataccactcaattcgaacttacccaacaagttgttgtccttagtcttggctctttcaccttcaaagacttgaatcaagacacctggttggttgtcagcataagtagagaaaacttcggatttcttagttggaatggtagagtttcttggaatcaacttggtcatgacaccaccagcagtttcaatacccaaggataatggagcgacatccaacaacaatagatcttgagtcttggaagattcgtcaccagtcaaaatagcagcttgaacagcagcaccgtaagcaacagcttcatctgggttgatagatctgtttggttccttaccgttgaagtagtcagtgaccaatttttggacctttggaattctggtagaaccaccgaccaagacaatttcatcgacttgagatttatccaatttagcatctctcaagaccttttcaactgggtccaaagtagatctgaacaagtcagcacacaattcttcgaatctggctctggtgatggaagtgtagaaatcgataccttcgaacaaagagtcaatttcaacggaagtttgagcggaggaagacaaagttctcttggctctttcacaagcagttcttaatcttctcaaagctctttggttggtagacaagtccttcttgttctttctcttgaattcttggatgaagtggttgaccaatctgttgtcaaaatcttcaccacccaaatgggtgtcaccagcggtggccttaacttcaaagataccgtcttcaatggacaacaaagagacatcgaaagtaccaccacccaagtcgaaaatcaagacgtgttcttccttacccttcttgtccaaaccgtaagcaatggcagcggcggtaggttcgttaataatacgcaagacattcaaaccagcaatggtaccagcatccttggtagcttgtctttgagaatcgttgaagtaagctgggacagtgacgacagcgtcattgaccttggcacccaagtaagattcggcagtttccttcatcttacccaagaccatggaggagatttgttctggggtaaagttcttggtttcacccttaaattcaacttgaatttgtggcttaccgtcaacatcgatcaacttgaatgggaagtgcttcatnnnnnnnnnnatcaccttggacttctgggtcattgaagtttctaccgatcaaacgcttagcgtcgaaaacagtgttagctgggttcatagcagcttggttcttagcagcgtcaccaatcaatctttcagtatcagtgaaaccaacgaaagatggagtggttctgttaccttggtcgttggcaataatgtcaacacgatcattagagaagtgagcaacacaggagtaggtagtacctaaatcaataccgacagctttagacattgtataaatatttctgtataaaatctgcttgatctgttggaattaatcaattgaagaatagaagtaacttaaataagagagtattatattttcaacattttttggagaaaacccagcccaattgcggcttatatataacaattcgtccacaccttcccatagtgcttaagaatgaaatttcgtcaaaacctcgaagctttttttttcgaaatcttcgatggaatgttctagaaaaaaacttcgagaaagtgaatcggaagaacttctcggaaaaaaaagcttcggaaatactacgaataagggcccaagagagagtaagaatgcagtgccatgcagtcaattcaccactgtgagaccgtaaaagggttggttgagtaactcaattcaaggaataaagatataaaattgataaaaaatatataacaaattgtaacaaaaagcaaaagagaggagtggaatgttatacaaagtaattagaaggtattgaacttgtaaaaagtaataataaaactcaattctgcttcttggtcacttgtggggcaccgcttaagcggtactcagacaagcggatcaagctcattttaattgcattataagctcttttgacgaatggtgggatagatgggtggcttatgatcccgtccattctaactctccattgagcaaaggcggctttcatgtacttggagttttcgtatcttaacttaataaagatggcgtacacaacaagtatgatccaagacctttggaagcacagaatggctctgaaaaggaccaaaatgaaaataagcagctcagcagtaccgacccagtgcatgcacaagtcattgtactgaacaacaaacttgtcgatgaagctgaggatcttacttgaatctttactggaaaggtggaagacttttggtaagagaactttttcaacgtagattaaaacatggaatacagcaaacgcgaaaaatgggattaagctgaatgaaaatcttggagtgaacaaccagaagttggccaaaaccaaataaagcacgtcttcactctttaggagtccagcaacgcgtgattttatggaagccttagtggcagcggcatcttgagtctgcaatggttcattgcgggtgaaaaattgctggtaaatgatgataccgaaagattcgatgacaccgagatatgccgatctgtaataaaattctgacatcttgagcaggtaaagaatggagctgatcaatacgacggaatgaccggtaaaccatgcaaactgcaagctcttggctactgccatgaacctttgcacgagcgacttatctctggcagggaggtttggggggccttggttattagcgggtcttgatgacattatactgactattcttggctagtgtttcttgctccttatgaatagagaaaaatgactttttttagatgtagtaagtatgtcatttcagggatggtctgcttgctctttaaatattttttcacccttttaaaatggggccctttcgccgtaccaaagaaggagaaatatacattacgtatgtaggttgctacatttttacacaaaactatcaatgccttctaggcttcttcttgaccagttgagagagatcattgaagtcaccaaggggcttttcgagggcggggaagccgatggaggtcgtgggctgcgaaagaggcctcttggagccgtgctgctgattttcttgcacctcatcaatatcgtcttgaatctgtgcgagccttgcctgctgtaactcgctgtccttgggtcttgtagtcatgtgtttttcaagcagagccttggcatgcttgaatctttttagtttgtccttagccggcacctgatcaacccaccttaaagcatcacacaccaaaaattctgcttgtatcaccttctcagttacttgttctgcgggtttcaaggtcttgtaatagccaagcgccttcaagtaatgatgaatggctctactgaacatctccgcctccctttcgatatcacccatcaggatatacacatcaccgatgcgcaatctgctgttctcggttagagattggccatctgctgtagggcggcccaacagtatcaaggcctgcgccagtaggtccaaagcgttctcatacagatcattttcaaagtaaatgttgaaaccagacttgcgaagttgcgatacgtcttcgatttcatcgtcatgttcattcgctggactgaagttagccaattcgtgcaaagctaagcgttcttcctctttctccacgttttcttcctcttcttcgctaccttcgccactgtcctcactatcaccactgtcgacatcaccagtcaagtcttcctcttcttggtcgaattggaacatcctagaattaggaatttctgtttgaccgttctcgttcccctcttctccattgctcacatcagactcaggctcagactcagactcagacccagatccatcgtcacctgccagaagagcgtccccaaacagattaccagaattctgtacttccatgttgtatacagcttgtgcgaatatagtaaacagttcaggatcaggcaacaaaccatcttttgggagagagtccaaagtttgttggcagcgtttagcagcttctaagaactttttctgtgcgagtaaatcttttgcaatttgaatctgtctttccatatcaatttgaagtttatgtctgctagttccgtttgccaacacgtcttctgcccttagtttcatattctgttacttctagaaggagacctcatcgccgatgttacctcaaaattgagtagaatgaaataatacaaaattggaaaaaacgcgaaacttcagtgcagtaacatatcgttccgacattctctgagaagtggtaagattccactgccggggagctacgagtgatcttgcaagtttttagacactgttatatccttcgactacgtaaccccatttttttatttttctatataaaaacatgcactgtatacatataatcacgtaagttcaagtcgtgcttaaaacgggcacagaaaactaactatgagttgccgtaccatacataaactaggagaaggtagcacagttctttttttaccaaaggtttgcacaaaaaagagggtctaacgtaagtaagttatcaataaaactgttaaaagtagtataagaatcttgagataggcttattattatgactttttatggcggaaaagggagaggaaatactgcgccgggtgatgcgtgacgcgtttttggaaacgatgagaataaactttgaagtattttgagaataatattttattatcgagttctttcagaagaaagcaacacatagctacgtatagttcggtaagataaatttggtcagaagcgtgtgaaagacgctgagaaaccacgtgagacgaagattcaaatcaaggcgtgaggaataacgcaatacgagccaccgaaacagaataaacaaaagaaaagaaagagtaaacatgggtacgtcaagcgaggtttctctcgcacatcatagagatatcttccattactacgtctcactgaagacttttttcgaggtgactggcgaaaatcgtgacaggtcaaattcgacacgagctcaaaaggccagagccaagctgttgaagctatcttcttcccaattttacgagctgagtacagacgtgtccgatgagctgcagaggagaatcggtgaagatgctaaccaaccagattaccttttgccgaaagcaaatttccacatgaaaaggaaccaggctagacagaaactggccaatctatcacaaactcgatttaatgatttgttggacgatatcctttttgagatcaagagaagagggttcgacaaggacttggatgccccacggcccccattaccgcagccgatgaaacaagaggtcagcaaagacagcgatgatactgcaagaacgtccacaaattcttcctctgtgactcaagtagctccaaacgtctccgtacaaccttctttggtcattcctaagatggcatctatcgattggtcttctgaggaagaagaagaggagcaagtaaaggagaagccaaatgaaccggagggaaaacaaacaagcacggatgaaaagaaagagactaaacctgctctaaaccccatagttacagattctgatctgcctgactcccaagtgctcgctcgtgatatcacatcaatggcaaggactccaacaacgacgcataaaaattactgggacgttaatgattctccaattatcaaggtagataatgatatcgataacgaaaagggtcccgaacagttgaagagccctgaagtacaacgagctgagaacaataaccctagctcagagatggaagacaaggttaaagaactgactgatttaaacagcgacttacatttgcaaattgaagatttgaatgctaagttagcatctttaaccagcgagaaggaaaaggagaagaaggaagagaaggaggaaaaagaaaaggaaaagaacttaaagagtaactacaccattgatgaaagttttcagaaagaattgctgtcattaaactctcaaatcggtgaattatcaattgagaatgaaaatttgaagcagaaaatttcagaattcgaactgcatcaaaaaaagaatgacaaccataatgatttgaaaatcactgacggttttattagcaagtactcttctgccgatgggctcattccagctcaatacatcttaaacgctaacaacttgataattcaatttactactaggctttccgcagtacccataggcgactccacggcaatttcccatcaaattggcgaggagttatttcaaatattatcccagttatcgaacctaatctcccagctattactatcggccgacctattacagtacaaagatcaggtcattttactgaaagcatcattatcgcatgcgatcacatcgataagatatttctctgtttacggtcccgtattaattccgaaaataactgtgcaagctgctgtttcagaggttggtttcgccatgtgtaatctaattgattcagcgaaaataaaatccgattcaaatggtgagagcaccacctctaatgaaggtaaccgacaggtattagaatattcttcaccaactgctaccaccccaatgacgccaactttcccctcgacttctggaataaatatgaagaaggggtttataaacccaagaaaaccagcatctttcttgaatgatgtggaggaagaagaatctccagtcaagccattgaaaattacacaaaaggcaattaacagtccgatcataagaccgtcatcgtctaatggagttccaacaacctcaagaaaaccttcaggaacggggctatttagtttaatgattgattcatcaattgctaagaatagctcccataaagaggataatgataaatatgtctcgcccataaaggcagtaacatcggcctccaattctgcaagtagcaatatttccgaaattcctaaactaacactacctccacaagccaaaatcggtactgttattccaccgtcagagaatcaagttcccaatattaaaatcgagaatacagaagaggataataaaaggagtgacataacaaatgaaatctctgttaaaccaacttctagcattgctgataaactgaaacaatttgagcaaagttccgaaaagaaatcatcaccaaaggaaaatcctatagcaaaagaagaaatggattcaaaaccaaaactatccaataaatttatcacttcaatgaatgatgtgtccacagatgattcaagctctgatggtaacgaaaatgacgatgcagacgatgatgatgattttacctatatggcattgaaacaaacaatgaagagagaaggttcaaaaattgaaaaaaataatgacagcaaactacctgcaaatatagtggaacttgatttacatgagtcaccggagtccgtgaagattgaatctcctgaatcgataaaggaaatcacgtcatctgaaatgtcttcagaaatgccaagtagttcgctgcctaagagattagtagaggatgttgagtcttcagaaatgccagagaagggcgcatctgtagaatcagtcaggaagaaaaattttcaagaaccacttggtgatgtcgaatctccggatatgacgcagaaggtcaagtctttgggtatgacaggaaaagctgtagacccagaatcagatagtagggttgaatctccgggcatgacaggacaaattaagtctttgaatatggcaggaaaagttgtaggcccagaagcagatagtagggtcgaatctccgggcatgaaagagcagattaagtctttgggtatgacaggaaaaattgcagctcaagaatcaatcaagtccccggaagcggctaggaagttggcgtcatcaggagaagttgacaaaattgaatctccaagaatggtaagggaaagcgagtccttggaggcagtaggcaatactatcccctcaaacatgacagtgaaaatggaatccccaaatttaaagggaaatactgtgtctgaacctcaagaaataaggagagacattgcctcctcagagccgatagagaatgttgaccccccaaaagtactaaaaaagattgtctttccaaaggctgttaatagaactggatcaccaaaatcagtcgaaaagactccatcttcagctacactgaaaaagagcgggctcccagaaccgaatagccaaattgtttctcctgaattggcaaaaaattcacctctagcaccgataaagaaaaatgtcgagttacgagaaactaataaaccacatactgagactatcacttctgtggaaccaacaaacaaggatgccaatacttcttggagagacgccgacttaaaccgtacgatcaaacgagaggaggaggacgaagattttgatagagtgaaccacaatatccagatcactggtgcagatacgaaaactggaaaaattgattatcataaaatacctgttgatcgtaaagcaaaaagcgatgcagaagtgcatacttccgaggaagatattgatgaatcaaataatgttaatggaaaaagagctgatgcccaaatacacatcactgaaagaaagcatgctttcgtaaatccaactgaaaattcacaggtaaaaaagacgagccactcaccatttttaaacagtaaaccggttcaatacgagaactcagagtcgaacggcggcattaacaaccacataaagataaaaaatactggagaaactacggcacatgacgagaaacattatagtgatgatgatgattctagctatcaatttgttcccatgaaacatgaagaacaagaacaagaacaaaacagaagtgaggaagaggaaagtgaagatgacgatgaagaggaagaagacagtgattttgatgtggatacatttgacattgaaaatccggataatacactatcagagttactattgtatttagaacatcaaacaatggacgtcatatccacgattcaatcgcttttgacatcgatcaagaaaccacaggtgacgaagggtaatttgaggggagaatcgaatgcaatcaaccaagtcataggtcaaatggtggacgctactagcatatcaatggagcaaagcagaaatgccaatttgaagaaacacggtgattgggtggtgcaaagtctaagagactgttcgcgtagaatgacaattttgtgccaattaactggcgatggaatattagcgaaggaaaagagcgatcaagattatgctgacaaaaacttcaaacagcggttggcagggattgcgtttgatgttgccaagtgtacaaaggagctggtaaaaactgtagaagaggcaagtttgaaggacgaaataaactatttgaattcgaagttgaagtaaagttagtagtatctagaggagaaagaaaaggaagacaaagacaatcaatagaatgtattatgtatgacatatgataataataattataataataataataataatagtagtagcagtaataatattattattatagtatattaaaacaacaaaaaattagtaaaaatactataaatgtttgaatatgaagatatatatgtaggaagaatttttattgaatatagaaatttaaagaaatattattaaaaaccggaaaatgaaaaagaagagttaaaaaaaaaaaacggaactagtaaaagatgtgaaaaaaagaagagaaaagtagaacgagaacacccactatccttgggtattattataagttgcaataccatcatccagtatgcccagattaaaccattcatggtccagagcgtcctttgcggtaatcctttttgttgggtcgaactcaaacattttcctgagtagatcgatgaaccagtaccaaaacaagaaagtttccttatcgagttcatcagtagttgaggaagaagaggaatgtgtttgtcttttccatgccaatttcgaatttatcaaagaccagtttttctccggcggtagattccaattgatgcttaagctatcgccgtaatcctgtttcaagacctttgagatgtaaatatctaagcgatcacatgactgcaagacccttttcattgacttttcggtggttatggtatctccgcgtttatttttttcaggccattgtaagcttaaagtttttctgtcgaaatgctttatcaccgttgaatttaggtctgatggagagttgcccaatttatgtttagatttgtaaaacatcttatcaataatgtctgtggggaaaggggttccattgattcgttgcatcatagccatatgttctagattttcatgaatggggtaaagagattcgccaataaccagttctactaggacacacgcgatggaccaaatgtcgcaggggaacgaccagcccaagccaaggacaatttccggggctctatagtgacgagtggatattacaggaggatgatattcgtaatggaaaattgcgctaccaaaatcaatgattttgatttctggatttttcaagattttgcgcttccccttactggcttcacggcgtctcttgcttagcgactgtacggttttcaaaggcaatttttgagcaatatgggtttcgtcacaaatcaggatattttctggtttcaaatccgtgtgtattatgcccaaatcgtgcaagaagcagacagatctgattagctgtctggcaatggcctgaatatgagagccggggaacctggcaatgccgttggagcacataaaatcgtaaatggacctgccgtatagatctgtcaccaaacaaatgtgatttttgtaatcgaagcactcccttagcaagaggcactggaactgaccttgagggtcattattcaaaatggtctgtagaattcttagttctgttttggcggcttccctatatctatctacagcccttatcacttttacagccacgtaattaggttcatacttgttatcgatgcatttaagcactttaccaaacgtgccttggcccaataggtccttcacaacaaagcggccgccgctgccaaaaatgtcgttttcctggtaaacgtagtgaccgtctttgtccgttttgaaatttgatttattggatgatgcgctttctgaagagccgtttgatgtaaatttccgtagtgaagaaccaatttgtttcttgagattggattgaggcagggaagctatttgtgctggtgggttgtaaaagggagaagtgctgtgagcaatcgtgagattcactgccttgttgccctccagagtctttgcacacgaccccgttagatgcaacaactcattttcagtttgcgttactcttggcacgatagcgttggtttgatcaggaacattaaaatagttcgattggtagctcagcttcgatagaggcaactgaggcagtgagatggttctttgcttcttgaatttctttggtgtcgtgatatacgtactattgcttgtaactgcggtaccgcaccctggattatttgaagtaacaatattattgttattattgatactgctgctactaggcagaatcaaaggtgacgaaaactgaattggctgctctttgataaaaatgatgtcatcgtcagcatcctcgtccactcgactactgttatgattattactgttattgattgtggtgttaatgatacgcggctcctcgtctagttctatggcattttcattgtccaagaacaactggtgttggtgttgccgaggacggagcggattgtctgcttgattcaggtctagactgttcctcagattgtctgttagaaaagaattttgccgagcaaacatctcgtccagcagcttgtttgtgcgcgtttcttcgaaattatccaaaaaggtcttgttagagcttgtattgttagcagggcccgtagtagtggaattattcatatttgctcttgaacgttttctagtgccaatttgaatattctgcgacataactaaggtacgcggaagataaagcaataatgaagaagagcagtatgcgtgtagattagtctttgttgtgccaaatcttcgacttggtaaatactatgtttctttcactctttttctgtctcccactttgtttcctttttctttttctttttttttttttgggtttgcttgctatctggcgcagtatttcgtgaatatagtatctatttagttagcgtaagcacgaggagttactgcactgtttcctttcacttgggggtgaggtaacaatactttgtaaatccggtagatctgggaagtaaatactaaactttattctaatataggaacttcataatataaaatccaacgcacgatgctagagataaaaaaagagggtgggagatgtggagccaggattcaaatcgaaaatcgtaatcggaaactaaaccagcattgcaaccgggccataagccatatcgttaagcacgccaaagctttttcccttcgctgtgtgtttcctcgcaactttaactccggccactcactaagccaaggcgtgaggagagagactaaagctttgtggaaaaccgcccaatcacgctgacccctttggcccgtttgccgccccctagaaaaaaaagaaacggacgggcctgggcccgcacagcctcgagcagggtcacttcgcgccatatcggcggctatttcaaaaaaagaagttctttaccagttgttgtagaaagtatgatattaccaacagcgtctagcttttattcgatattccgatgtgggcggctatttattatcggtggcgtcttttatggttttaccgttgttgcctggagcatcctcaggaagacctaaatgtgaccattcatcgtagtccatcaattggtggtccatcctgcaccgcaggtagtcctttgccagtaatctacaattcattgcattttcgttctgcacaagctgcatacatttgagatactcttgcatgtacttggtgcattcgccgtcgtggtctagcgggaacgaacctctctcgggtggagtaggtctcaatgcgctcagcgagcttcctgggttccctgacattggattcttgtgttatgtttcgtaaaagatactttgtgtgtagtgggtgcgtttgcttgttttcttgaagtatagaagaaggaaagaacggaagaaaaaaattttttccctcttgttcgctttatttggattttctcgtttctcaactccgcgaatttgagcccttttcttagaccccggagggaagatgcagagatgtagtaataaaagctttttatccaaaaagcttttaagctgttgttttaaaaaaggttaaatgggcgctttagaggtcgggtagtgggcaaagcctgcgataagaaaagagggagcgtgctacttgaccgggagcagcaaaatgggcggcccgagccttagatcatactcatcgccgataagagtcagcttggtaatagaaccgctagtgcgtaaatgaggcatagaacttgttctcgtcctaaaaaactgcccaaaataatattttccaggtttcttgaagagtaatcttgttatgtaatttttttttgcctgtggattgtataagaaaccagaggcggtcaaaaacgcaaaaagcggcatggtaggcgaaaatactaggacgattactactcaactgacgcgtcaacttaatattgtcctggtacataaccgaccatcccagatgcgctgtaagtactgtttaaatgtattttaatatgtgcatagagcgtgtaaattatggcgaactatggtttccgaattgtcggactgctcaaagcccttgctttcggaatattcgaagtgatctggcggtaaagaaagtgtgacatatgtcagacgttgagacttatatgtgtaaagctaaatataataattcagttaaaataaaagtgggtgacaggaaaaaattagaaatgttgaaaatttttttaccttcactcgctacataaaaacattggaggagactccttcatggtcttaatctctttggatctcttgggaacaatgaagctcttctgatatttttcaaatccaaatagaacataacaactctttccaaaccgataccaccaccggcgtgtggaggacacccatagctgaagccgtcacagtagtcctttagacctgggtcctcaggagacaaaccatgggctttcatcctttcttgtaatagagcatggtcgtggatacgttgtgcaccggacaagatttcttcacccctcatgaagaaatcatacgagttagaatacttagggttggctgggtcgggcattgtgtagaagggacggatctccaaggggaacttgtctaggatgtaaaagtcggtgtcgtatttgtcgcgaaccaacttacccaagaacttttcattttcggtactcaagtcttcaaaatcaccaatttccttaccggcagctcttagcatttcaataccttctttgtatgttagacgaaccatcttaccatctttgggtaacttgaattcttcaacagggtattgcttacgtaccaactcaatttcatgagcaaatcttttgggcaattcactgaagataaacacaaacaactcactcaacgtgtccaaaacttcgtggtaatgttcttcgaaagccatttccatgtccaaaccagtaaactcggtcatgtgacggtgggtgttggagttttcagccctgaacactggcccgatttcgtaaactctttcaaagtcggccacaatcaattgttgcttgttaaattgtggagattgagctaggtaggccttccctttgaagtatgtcacctcaaacacactggaaccaccttcacttggtgcacccaacagttttggtgtgtgtacttcggtaaatttctttgtggccaaatattctctgaacagctcacaaacaccagcttgaatcctgaaaatagcttggttggtgacggttctcaagtcaatgacacggtagtctaatctggtgtccaagttgaccacgggcaaacctgcagcttcagcttcagcttcggaacgggaggcatcttccaaaagaattggcaatgcttctggagtctcggaaatggtataaattttggtaatgtgaatttccaggttttgcacagtagcagacttgattggctcatctaccttcttgacaatacctttgacaaggacaatggactccagattcaatgaaccggcccatttgaccatgtttttgctgatggtaccttccttgttggcctttactagaccttggatcaaggatgcttgttgccttaaagttaaaaaggccaatgttgcaccttgttgtctggtgttgtggactcttgccctgaaaaggacttctttgtcgctatccttagcctcatccaagtcaacaaacttgacacgcttctgaccagttctgtcagagtcacgagactggatcaatggcaacttaccgtagttgtcctttgcggtgtcttcggcagcggctttcttttcacgggcttctctttcagcttccaactggagggctctttcctccttctttctctgtttctcttgctctttctgcaatttcttcaaggctttcttggacaatggcttaccatcttccccaagaataacttgagcaggttctgcggattcttcaacagctttgacaatattttcgtcttgagacatcacgtaaaatgtttcttttttcttttacaattaaccttaagaggccgttccagccaatgatggaaaacttaaacaaatcggttgtcttgcttcatccttatatgacattaaataatttttcatttcttcttttttcacgaaaatgcgtcataaggtacccgtcactgatgatttcatagacaataaagcaacagcacaacggaaaagagttcttatggatgagtcccaatcctacttgttttctgtacctcaatggtacaaaatgtgacggtaatagaatatatactttcataatatcatagaaacatcttcagcttggcctgtctctttgagaaacaaaaactgcatgtgcacaattactgcagatgaacttcaaggaaacatatgtcctgcttggagggtcagaagcaaaccattctagctgtatttgcaacgtacatttgtaccaaatgtacgtcattatgttatgtcgtcagtgtagatatatcaaatttgcatgcggctgtaccgcatcattggaaaataatgtctgcaggctcgcaaaatttaagggttcccttctaaaatagtagtcaaaattgcttttttgcataacaaagtgaaaaaaaaaaatgtgagagacaaacctaaaagacatatataatctgccaccagaatgagttgcactgcgtcatatgccggcatgacaactccggtgaaggataaggaaggccacgggattccatgcttacaacctatcgatgtagtggaatgtacatatgaatattttacaaagtcacggaataaactgtctttaagggtaggcgatttgatttacgtacttaatgaaggttctaatggctggtgggatggtgttcttatcagacacagcgctaataataataataatccgttgatactagacagaggttggttccccccttcttttacacggtccatcctaaacgaactacacggggtgcctgacattggtaacgaattggaaatatttcaagcgggtattaatcttaaattggaattatcaagcaatccagtcatcttatcattggaagactttttagactgctgtcgcaatatcgaatttaaggaacaactggcttggtcacctattcccgcccacgaaaataaagactgctgtgagctgctgtactataaccaggatttagatgtttattgtcgcacgttaccatatttaccacaaaatcaagttgaaacaatgaacgattattcgtctcttcctgcattatcgaagatagctggtaaaaagatgcctataacgtcaagccccgatctgttctatctcaatgactgtgatgtcgtctattggtatgacctcactcgcttagtgtgtcattatgttaatttaacagagcgcgacctattggcaaatgaacgggaaaagtttctaacttccttggatttactaacagctcaaataacctatgtttatatgcttttcaggaatctccgtttagtcgaagataatttcaaaaaaaccctcaaaaaactaatttacaccttgtctaggttttcaataaatgcaaatatttggtttcattccacattgtttgaagaaagagaagccatagcctcccagaaggatccagaaagaagatcccctcttctacagtcaatcctaggaaccttccaaaaatttcattttctactgcgtttactacatttcctctcaaatcctaacgaacttacaatactgcctcaattgactcctcgatttttcaaggattctttcaatacaatttcatggaataacccgtttttgcgtaagcgtctcaaccagcatatgtcccatgacctaccgagacagatgattaaagccgttgctggtgcttcaggaattgttgcggaaaatattgatgaaattccagcttccaaacagggcacttcatgctcgtcagaaacgtctcaccattcaccatcagccccgtttcaaagaaggagaagaggtaccattttctctaatgtgtcaggaagttccgatgagtctgacaccatatggtccaaaaggaaaaaaccatacccgctaaatgaagaaactctaagccttgtaagggccaggaagaagcagcttgatggtaaactaaaacaaatgatcaaaagtgctaatgaatatctcagtaacacggctaatttttcaaaaatgttgaattttgaaatgaatttcaaaacctacgaagaagtaagcggaacaattcctataattgatattctggaaaacctagatttaactatttttctaaacttgagagagttgggagatgagaatagagtttttgacgaagatgtcgctattgatgatgaagatgaagagtttttgaaacattctttatcatccctatcgtatatcttatccgactattttaatatgaagcaatattttcatgatgtagtagtgaaatttataattgtcgcccagcatttgacattagaggatcctttcgttttctcgccaatgcaaaacgacttgcctaccggttattatgaaccaatgaaaccttcatccttgaatttagataatgccaaggataagaagaatgggagccaaaatactgatatccaagaggaggaagatgaatatgagccagacccggatagtcttattctcttccacaacctcatcaatcaagattctgatttcaatgatttaaagttttttaatctcgcccacgtttttaaaaaatcctgtgatgactattttgatgtgcttaaactagccattgagttcgtgaatcaattaattctagaaagagagaatttgttaaattatgctgctagaatgatgaaaaacaatatcacggaattgctattgcgcggggaagaaggctatgggtcctatgacggcggtgaaactgccgaaaaaagtgacacgaatgctgtttatgcagattcagatactaaagacaatgacgaatggcgtgacagccaagtcaaattaccgaggtatttgcagcgcaagtatgacagtgaactgatttggggctctaacaataggattaaaggtggttctaaacacgcactgatctcttacttgacagataatgaaaagaaggatctatttttcgatattacttttttaatcactttcagaagcatctttactacaacggagtttttaagctacttgatctcgcaatataatttggatccaccagaggatttgtgctttgaagaatacaatgaatgggtgacgaaaaagcttataccggttaaatgtagggtggttgagattatgacaacctttttcaagcaatattggttcctgggctatgatgagcccgatcttgcgaccctaaatctggattattttgcgcaagtagcaatcaaggaaaatataacaggatctgtggaattactaaaggaggtcaatcagaagtttaaacatggtaatatacaagaagcgactgcaccaatgaaaacgttagatcaacagatctgccaggaccattactcgggcactttatactctaccacggaatccattttggccgtcgatccagttttatttgccactcaattaacgatactagagcatgaaatttattgtgagataaccatttttgattgtttacaaaaaattggaagaacaagtatacaaaatcgtatggggcttcaccgggtttgaacgagtttatcagttttgccaataaactgacaaatttcatatcctactctgttgtaaaggaggctgataaaagtaagcgcgccaagctactctctcattttatttttatcgcagaatattgtaggaaattcaataacttttcttccatgactgcaatcatttcagcattatattcttcaccaatttatcgtttagagaaaacctggcaggcagttattcctcaaacgagagatctattgcagtcactgaacaagttgatggatcccaagaaaaatttcataaattacagaaacgagctgaagtctttacttagcgctccctgcgtaccgtttttcggcgtttatttatctgatctaacctttactgattccggaaatccggattatcttgtcttggaacatggtttaaagggtgtccatgatgagaagaaatatataaacttcaacaaaaggagcagacttgttgatatcttacaagagatcatatatttcaagaaaacacattatgatttcactaaagatcggacggtaattgaatgtatatcaaattcattggaaaacatcccccatattgagaaacaataccaattatcattaattattgaaccaaaaccaagaaagaaagtcgttccgaattccaattcgaataataaatcacaagaaaaatccagggatgaccaaaccgatgaaggaaaaacatccactaagaaagacagatttccaaaatttcaattacataagacaaagaaaaaagctcccaaggtttctaagtaacggcgccgtatgttcgatttccttctctcggtggattaattattttgtttgttttctcctgttatattatttattgatcactatagtaaactatgtccgtcatcaagcccgacggctgctatcccacaatgttgatcgtattgtttgcctagtttattatatatttgcttatttatagcataccataatatttaaatgccctcaaatttttggccgtagcgacatcgcgataattccaattccctttaaaaaattgtccctgagtataagttaattcagccagttctccaaattaaaatcgcatactcctgaacctatcaacagattgtcctcgcatacttttctataccaaggtctcttctgaacatatattagcagtggttaattttaaagagatcataaagaaaattttgtctaaaaaagattaatataaagacaatgtcttcactagaagtggtagatgggtgcccctatggataccgaccatatccagatagtggcacaaatgcattaaatccatgttttatatcagtaatatccgcctggcaagccgtctttttcctattgattggtagctatcaattgtggaaactttataagaacaataaagtaccacccagatttaagaactttcctacattaccaagtaaaatcaacagtcgacatctaacgcatttgaccaatgtttgctttcagtccacgcttataatttgtgaactggccttggtatcccaatctagcgatagggtttatccatttatactaaagaaggctctgtacttgaatctccttttcaatttgggtatttctctccctactcaatacttagcttattttaaaagtacattttcaatgggcaaccagcttttctattacatgtttcaaattcttctacagctcttcttgatattgcagaggtactatcatggttctagtaacgaaaggcttactgttattagcggacaaactgctatgattttagaagtgctccttcttttcaattctgtggcaatttttatttatgatctatgcatttttgagccaattaacgaattatctgaatactacaagaaaaatgggtggtatccccccgttcatgtactatcctatattacatttatctggatgaacaaactgattgtggaaacttaccgtaacaagaaaatcaaagatcctaaccagttaccattgccgccagtagatctgaatattaagtcgataagtaaggaatttaaggctaactgggaattggaaaaatggttgaatagaaattctctttggagggccatttggaagtcatttggtaggactatttctgtggctatgctgtatgaaacgacatctgatttactttctgtagtacagccccagtttctacggatattcatagatggtttgaacccggaaacatcttctaaatatcctcctttaaatggtgtatttattgctctaacccttttcgtaatcagcgtggtttctgtgttcctcaccaatcaattttatattggaatttttgaggctggtttggggataagaggctctttagcttctttagtgtatcagaagtccttaagattgacgctagcagagcgtaacgaaaaatctactggtgacatcttaaatttgatgtctgtggatgtgttaaggatccagcggtttttcgaaaatgcccaaaccattattggcgctcctattcagattattgttgtattaacttccctgtactggttgctaggaaaggctgttattggagggttggttactatggctattatgatgcctatcaatgccttcttatctagaaaggtaaaaaagctatcaaaaactcaaatgaagtataaggacatgagaatcaagactattacagagcttttgaatgctataaaatctattaaattatacgcctgggaggaacctatgatggcaagattgaatcatgttcgtaatgatatggagttgaaaaattttcggaaaattggtatagtgagcaatctgatatattttgcgtggaattgtgtacctttaatggtgacatgttccacatttggcttattttctttatttagtgattctccgttatctcctgccattgtcttcccttcattatctttatttaatattttgaacagtgccatctattccgttccatccatgataaataccattatagagacaagcgtttctatggaaagattaaagtcattcctacttagtgacgaaattgatgattcgttcatcgaacgtattgatccttcagcggatgaaagagcgttacctgctatagagatgaataatattacatttttatggaaatcaaaagaagtattaacatctagccaatctggagataatttgaggacagatgaagagtctattatcggatcttctcaaattgcgttgaagaatatcgatcattttgaagcaaaaaggggtgatttagtttgtgttgttggtcgggtaggagctggtaaatcaacatttttgaaggcaattcttggtcaacttccttgcatgagtggttctagggactcgataccacctaaactgatcattagatcatcgtctgtagcctactgttcacaagaatcctggataatgaacgcatctgtaagagaaaacattctatttggtcacaagttcgaccaagattattatgacctcactattaaagcatgtcaattgctacccgatttgaaaatactaccagatggtgatgaaactttggtaggtgaaaagggcatttccctatcaggcggtcagaaggcccgtctttcattagccagagcggtgtactcgagagcagatatttatttgttggatgacattttatctgctgttgatgcagaagttagtaaaaatattattgaatatgttttgatcggaaagacggctttattaaaaaataaaacaattattttaactaccaatactgtatcaattttaaaacattcgcagatgatatatgcgctagaaaacggtgaaattgttgaacaagggaattatgaggatgtaatgaaccgtaagaacaatacttcaaaactgaaaaaattactagaggaatttgattctccgattgataatggaaatgaaagcgatgtccaaactgaacaccgatccgaaagtgaagtggatgaacctctgcagcttaaagtaactgaatcagaaactgaggatgaggttgttactgagagtgaattagaactaatcaaagccaattctagaagagcttctctagctacgctaagacctagaccctttgtgggagcacaattggattccgtgaagaaaacggcgcaaaaggccgagaagacagaggtgggaagagtcaaaacaaagatttatcttgcgtatattaaggcttgtggagttttaggtgttgttttatttttcttgtttatgatattaacaagggttttcgacttagcagagaatttttggttaaagtactggtcagaatctaatgaaaaaaatggttcaaatgaaagggtttggatgtttgttggtgtgtattccttaatcggagtagcatcggccgcattcaataatttacggagtattatgatgctactgtattgttctattaggggttctaagaaactgcatgaaagcatggccaaatctgtaattagaagtcctatgactttctttgagactacaccagttggaaggatcataaacaggttctcatctgatatggatgcagtggacagtaatctacagtacattttctccttttttttcaaatcaatactaacctatttggttactgttatattagtcgggtacaatatgccatggtttttagtgttcaatatgtttttggtggttatctatatttactatcaaacattttacattgtgctatctagggagctaaaaagattgatcagtatatcttactctccgattatgtccttaatgagtgagagcttgaacggttattctattattgatgcatacgatcattttgagagattcatctatctaaattatgaaaaaatccaatacaacgttgattttgtcttcaactttagatcaacgaatagatggttatccgtgagattgcaaactattggtgctacaattgttttggctactgcaatcttagcactagcaacaatgaatactaaaaggcaactaagttcgggtatggttggtctactaatgagctattcattagaggttacaggttcattgacttggattgtaaggacaactgtgacgattgaaaccaacattgtatcagtggagagaattgttgagtactgcgaattaccacctgaagcacagtccattaaccctgaaaagaggccagatgaaaattggccatcaaagggtggtattgaattcaaaaactattccacaaaatacagagaaaatttggatccagtgctgaataatattaacgtgaagattgagccatgtgaaaaggttgggattgttggcagaacaggtgcagggaagtctacactgagcctggcattatttagaatactagaacctaccgaaggtaaaattattattgacggcattgatatatccgacataggtctgttcgatttaagaagccatttggcaattattcctcaggatgcacaagcttttgaaggtacagtaaagaccaatttggaccctttcaatcgttattcagaagatgaacttaaaagggctgttgagcaggcacatttaaagcctcatctggaaaaaatgctgcacagtaaaccaagaggtgatgattctaatgaagaggatggcaatgttaatgatattctggatgtcaagattaatgagaacggtagtaacttgtcagtggggcaaagacaactactatgtttggcaagagcgctgctaaaccgttccaaaatattggtccttgatgaagcaacggcttctgtggatatggaaaccgataaaattatccaagacactataagaagagaatttaaggaccgtaccatcttaacaattgcacatcgtatcgacactgtattggacagtgataagataattgttcttgaccagggtagtgtgagggaattcgattcaccctcgaaattgttatccgataaaacgtctattttttacagtctttgtgagaaaggtgggtatttgaaataatgacattgattattatatatgaagatatagaacatttaatgcgctgcaatatgtacggtcacgccaattctttttctttctatatgctttctagtaacccgggtaatcacaaatgaagctagtagagatataactaaatacaacttaattttaaccttatgttggattgctcaagcagtgttcgagaaagacagcggcagacagatagaaatgagctcaaatgaagaggtatttactcagataaacgcaactgcgaatgtggttgataataagaagcgtttacttttcgtgcaagatagctcagcacttgttctagggcttgttgcaggatttttgcaaatcgagtcagtccatgggtttatttggttcctgattctgtacaacttgattaatgtcatttacattgtttggatctgtcaacttcaaccaggaaagttctaccaaagcccacttcatgacatttttttcgaatcgttttttagagagataactggttttgtcatggcatggacatttggatacgccctaatcggatgaacatataagaactacttctataaacggttagaaacaggcttgatttattatgtacagtaaatataatgttatttgtgttttttttttttaaatttttttagttccttctatgtaaaaagacatgacaacagtattctcagtcaaatgatttcaaatacacaatgttaaattctctatctgttgcagaaataagaagagcgtaagagcgcaaagatttttgcagaaaaatagagatgaggtacaaaaagtaggtaatggaaaaaagcaaataatgaatataggggaacataaatgttatggacaagagtagatatcaaaataaaacaaaataaaatagagtaagtgaaagacaaatgnnnnnnnnnnnnnnnnnnnnnnnnnnnnnnnnnnnnnnnnnnnnnnnnnnnnnnnnnnnnnnnnnnnnnnnnnnaaaaaatagtaaaaagtgaaaggagaacgatgataacactaatcacacctccgcattttcaaccaatgctgcaagtttctcaacactggctaaatgtctatttcctagggagttagatttgtttagtttatccaaatatgctctaatggcaatgacgatcaatttcttaccctcaccctcagagacattaactaatttttgaatcacatagttggcaaattgatccttgatcattaaaatcattggagaatcgtcttccagattcaaagcatgatttttgtctcttggtaaaatcttagaaattattaaatccttctgatttttagagccataaagaatagatttttcgaccacgttggaggcaaatttatgtttagagtattcgacaacattattggccacagtttctatgatttcctgtttgatatcgaccatttccttattggtgaactgatcttgttgcaaaacatattgaatgacatagttaccatattggtcttgaattagatatggtatgaaatctttcaattcgtttaaaatgctttcctgatcttcgctcgaaccaaattctaacaatctttgaatgaccctacagccgtaggagtgggtagatagatggtaaatgtggccagttaaagaacttaagataaaaggtaatttttcgataggaattgtttcgatggccttttgaattacgtgattaccgttctgatctttgatcatttgcaaaacggagtcagataattccaggactaactcaattctttgattggaatcaatatattctaacgccttttgaattacacgacatgcgtacatttgtagagataactgtttcatgttacctttaaattgatcaaccaaagtatttttttgaattttgctaccaaattcaaaaaacttctgaatgacgtaattaccaaatacatcgttcgaaagctcaatggcgtcatcgcgaatttcattgaatatgacctccttttctgaggctggtgaggtggccaactcgcgctgaatgaaccgtgaaccatgttgatctttgcaaaactctaaggaatggccaaagatgtcttttagtgacatgttcgagtttgaatttttgtcagaactactgtttcttagttgctctaacaacggcgatcgatgatacgtttgctgctgttgctgtagactttgagaatgaggatgagaatgagagtgagatttatggttgttggccgttgactcattagatttggaagaagcattctttttagaggtattctttgtgggtatagaattttctagataaggatttgcctgtttgttggcgttgttggagttatttgcaggatgattcttgttatttcttttcttgaaggttttttcgtccttgggcattttgacaggtataggatttggagtagggtagtaaatataaggattctcctgttgctgttgctgttgttggtcttcttgttgttgttgttgttgctgttgctgttgttgctggggagcagagagtggtggaggtggcataaacatcattgggttggggtaggcaaacgggaacggagaattgtttggaggggacgaaggtgaagaaacagaagaaggtctgtttgccttcttctttttcttaccatttgagtcttcggtgtcttcatttgctggaatctgtactgaaatcatctgggagatgaaatttgaaggagatccgatcaagtagttggggaagttttggtaatgagggccctgatgaaactgattgggtgggaagccgttcatgtagggggggaaattgttatttgcaggcccatcttgttggttaggaagcgcgacatttgtggccccaacagcggctggattgttactaggtctaaatactggtgtgttggctacgttccagatatttctcttggggtaatgagcattttcggactctaaagacgcagatgagcctgaatttgaactggagtggtaaagcgaaccactgttagtggtgttcctattcaatttgttgaagtttttgtcagactcgacattttgctcgaaagtattctgtgtgtctaagctggcgttagagacgctttttgatatgaattgggactgagtattgacagcgtcgggtctatcttgagattccagttcccttgtaccgtcaatcaaagattttccgaacttctcaaaaaacccttccccaccagagttgttgttctcattgccattgtagtaaacgggaccagcaatggaagctgaatactggcccagaagatggttgaccttgttgtttttcccgagattacccgcagtatgatgagtatgatagttattgtacgatgcggatgacagggaggcagtgtcggttgatctgtactggtaataattgccgccgttaccaaaaaacttcttcgagttcgtggagaatggcggagcagtaccaactgatagggcggttttcttgaagatcggtgaagattcactggaaccgtgaagcagcaagatctctgaatctacttcatttgccgtggtgaaactcgaccttctgaagccgccaatttgctgtgatccagcagcaccgccgctcacaatgccggccgcggcggcctgacccccgttgttgttactattggacagggcgcttaaagaagaaactatggatgcgagttccatatccatatccatatccatgttcatttccatttatacccgcaatattgcgttattcagaagaaatttaaatgcgtagttcttgtttgttttcttgtttgcttgcgtacttctatgcttatagatatatcagtagcaaggaagtttccttttcaccgcctttcaatgttcctatctttttcttatgtttctctttagagaccagatgaccagaaaaaaattagctaagcagtgttatactatttacagtagatattcaaatatgtgcaggcaccacttatttttctttttccttcttttctttgttttttttttctcctattcatcaagcttcatacatccaatatacattctcaagtgtgctaatggtacatttgggaaattatcttcctctctccacaatttttagaaggaaaaaagaaatgcagttcagggtaacagagtgcgcaattaccgtagatagcgatcggatgtttatctttagccctctttttctagctcaaaccccggcacgaattttttaggtcttgctgctctgccctcaggcacttttcttcgagaagttctggggcggtctgatcgggaaaaaacgttcccttttcggacgtatcgcaggcaatgtgcaaaagcttattatatacgagaaaagaaacgcgaaggaacgaaagaagatgaaaaaaatgcagcgataaaatgatattgtggttaatctaaatttatatatatatatatatacatatatatatagaaatctattgttatacacaaaaatacttattttttaatatagatggctgcagataaagtaatagttttatatataggtatatttactgcacaattcacacgatgggtgtttctgcggtgttgaaaagagctaggaatttactagcaacgttcatagtctgctgttttatggcagtagtgcttgttctggcgctggcacaccattttataaatgagcacagagacactaggagttcatcgacccaaatcgaagttgatgacgaaagtaaaagaaacgtacaccatgaccatgttctcactagaaccaatgcatacgcgacgccatacctcgatctggaacatgacaagaaaaacggtatcgtctacgatcatacaagaacggttgtccgtaaaaagaaccacgaagtggggtcctcgtcactgcataaaaacctttttcacaaatttttgacaaagcttatttttaggtttatcgagaaggaaaaagttaccgaaggcgtaacgcaaggaaagttcaataatagtagcaatgaaattgccaatcatgaaccggtttttgaaaaaattcctgtacagtgcgacaatccattacagaatctaatcttatcggaagacttgacattagttgcggatcttaattattattttaaccagtacaatattcaaatagaggaatttagattggagaccgaagatgggtttgttatagatttgtggcacttgataccaaaatatagaacgacagattctgacaagaagaagaggccacccattttgatgctacatggccttttgcaaagcagtggttcgttcgcatccaatggtagaaaatctctggcatattttctgtatcaatccggttacgacatatggttagggaataacagatgcgggtttaggccggaatggaacgaagcgaaagtaccgacactagcttccaggtgggactgggaccttcgcgagatggttaagtacgatctgacccttttgattgataccgtgttagctaagacgcagtttgaaaagcttactttgatctcgcattctcagggcactacacaggggtttatgggcttggtcaacgaagataagtttttccctcccggttcgggatctaaagaatcttttttcacttctaagatcgcaaactatattgccttggcccccgcagtgtatcctggtcccttacttaacgagaaattgtttgttaagcttatgacaaaggaaatcgaaaatccctggttctttggtgaaacgagcttttttgagataatgatgattgtaagaaacttgtgcgttggtgagagcttgttctcctttgtttgttacaccatcttcaattacctgtttgattggaacgataccctttgggataccgcattaagagatcgccatttcctgttttcgccagtccatgtttcagtgaagttgatgcaatggtggctgtcacccgaccccaacaaggtaagttttaaatttggttcccataagatgttccccgacaatgttaagtggttttcagacgcatcaaaggccccaaatatctacttgtttgttccaaagcaagatagattggtggacggagaaagactaatcaatcatttcgtcaatgtggagtcgaatgtcaactacaagatctggtacattgatgagtatgcccatattgatgtcctatgggcacatgatgtcatagagagaattggtaaaccaattttacagaatttgaacaactattactccaagaagccatccagcgcctttgaaagtgattgttcggacacagaggtggaaacggagctggaaatggttgctgagaaggcttgaagaggaagcatgatatataggttaatataaattatacttgggaatacatagatagagggctagtaaatttttagtttttaattgttctttttttttgaagtattgtgtcacaaattgtcgggagttgggacatcaccgtgcataacgatacatttttttgaaaaatttgatattgaaaaaaaatcgatgagtttgaattacattacagttgtataaagcaaccgcatttcattaacgtagtttgactcgcgaagataaggcgttaaaatgaagattaagaccattaaaagaagtgctgatgactatgtccctgttaaaagtacgcaggaatctcaaatgcccaggaatttgaaccctgaattgcatccttttgaaagggcacgtgaatatactaaagctttgaatgccaccaaattggaaagaatgtttgctaaaccctttgtgggtcagttaggatacggtcatagagatggtgtttatgctattgccaaaaattatggtagtctgaataaattggctactggttctgcagatggtgtgattaaatactggaacatgtctactagagaagaatttgtttcctttaaggcgcattatggactcgttactggtctttgtgtgacacagcctcgttttcatgacaagaagccagatttgaagagccaaaatttcatgttatcttgcagtgatgacaaaactgtcaagctatggtcaataaatgttgatgattactccaataaaaactccagtgataacgactccgttactaacgaggaaggtttgattcgtacttttgacggtgaatctgcatttcaaggtatcgattcgcacagagaaaactccacgtttgccacaggtggagccaagatccatctttgggacgttaacagattgaagccagtttccgatctatcatggggagcagacaacattactagtttaaaattcaatcaaaatgaaacagatatcttggccagtactggtagtgataattctattgttctttacgacttgagaaccaactcccccacacaaaagattgttcaaacaatgaggacgaatgctatttgctggaatccaatggaggccttcaactttgtaactgccaatgaagatcataacgcctactattatgatatgaggaatttatcacgttcattgaatgtattcaaagatcacgtcagcgcagtaatggatgttgacttttctcctacgggggatgagattgttactggttcgtacgataagagtatcagaatatataagacgaatcacggacattcgagagaaatttatcatacgaagagaatgcagcatgttttccaggttaaatattccatggattctaaatatattatcagtggatctgatgatgggaatgttaggctatggagaagcaaagcttgggagaggtctaatgtcaaaactactcgtgaaaagaataaattagaatatgacgaaaaattaaaagaaagatttagacatatgccggagatcaaaagaatcagtagacatagacacgtgccacaagtcatcaaaaaggctcaggaaattaagaacattgagttgagttctattaagagaagagaagctaatgaaaggcgtactagaaaggatatgccatacatttccgaaaggaagaaacaaatcgttggtaccgtgcacaaatatgaagattcaggaagagataggaaaagaagaaaggaagatgacaaacgtgatactcaagaaaagtagttattctgttttatgttgtctgtatatacgcatatgtacaatatttgcatttttttaatttttaattcacatgtatttgataaatgttcacgccagttccgttaaattaaaattaccattttattagattatgaatttatatatgaatacattgtgtcgtaatggtagaagaagttgaaaaaaaaatgtcaagggacagcatgggtacagtgtgttgagccaaaaaaaaaaaaaaaaagaaaaaactttttgttctctggttcttttcttcatcttcttcatcttcattctttggtagcgggggccacaagaaattcgggcgaaagtgctcattatattgttacatccaaaattttgcccacatccagtgaggttttcacagaaaggtcttctaaaagaggaataatatctaataattcgttatcatgagtatctgagaaccaggacgaaatcggtattgcatgttggggatgaaaaatataagatgccggagagttatcgagaatgatgatatctgataacggccttccaatctgggataagttttttatatagtttccttcatagttatagcaagcctctctgaataatctgtgatgaatgactttatctgtgtctaatatatcaagcaaaggatcaccgtatcgagagacactagccgtgaagactacaacctcgaataattttccgactctttccaaaaattcttccacaccaggtcttttaatgacatagacattgtgtacttggtcatctatttccacaggcaaaacaaaatccgcagatcgtaagtatttgaaagaagagtgtaccaaggtttcatccaggtccagtattaggcatttcttgccctttgtactttcatcttgtggggggagcagagtgttgtaacctggtgcatggtactggccctgctgcaaaagcgttagatcaatatattcttcatcttcatcgtcttcgtcgtcgacatcgttggaagtttcactggcttgagagctgctgcttaccctactcaaattcatatcttggataagatggtcagacgatacttgtacagtaggccctcgctgctgcgactgcgactgtgactgtgactgtgactgtgactgtgactgtgactggggttgtggttgtggttgtgactgtgactgttgttgttgttgctgctgttgttttttctgcctggaagtatctttcacagcatctcctttttcctgtacaatgccacggctacgacggttatcttcatcgtcgatctcttcatcttcgtcaacctcgtatttttcctcgtaaagatcatctttactaattcgcttctctacttttgtcatattattagtagtagtggcggtgacggctgcagtcggcgacgattgcttctttttttcattatcgttcgtgcttatcccagatttaccggtggatcgttcagtggaactgaaagtagcggccgaatttgtcttagaaggaggagagtttgtctgatgtacgccacgggttcggcttttcgtgttggaatgtttaacgcttctgtttttattgagagaactgctctgttgttggcgataagcagaattggaattggattgtgtcgtctcggaagagcagcacagtattgacgatatgaaacccatcctgttttgctacttattgttgttaaagcttacgaacacgaatgtaggcaaataaaaagcttggataaacgcacaatgaaaggggaagtgcgattgattatgctataaggaatgatacgaagagaacagactataggctaggcaggcgattaaggaaggagttgtacttgacgacaacgtaataaagagttcaatgaaagagtattgtgagcagtatggttcaacgagcacttcttctcgacagctatttctatactttttcacttaatatacactaactaatcccagacttttttttttttttcggttctttccagaaaaaaagaaacaaagcaagcgtgccctgacttagggtttcctaaaaaagttattaggtttgtgtcacgtgatagtcctttctggtcacgtggtcttagaacactcttaaggggccaagcacaagaggacagtgctagcagtagaagtggtgtagtagtgatgaggtaatgttaattgtgcatcgcacatatttacaggtagtatatactatagtttgtgaatacctattcttatatatacaagaaatggttgtcggcagactgtcagtaagactaatttgcacttggaacttcgaagccataacccttcatgcactctttgtacttttcaataaattccttgcatttttcagagtcttgtccattgaataagatgcatgtatcccgctcctccttttctggcttacaaacacaacatggcttaggtttgtcctcgcactccgcgtggttttcttgttcttgtttcttgtcagtttcagtcattgggtataattgattgtgtagttatctgattgtgtacactaaaattttgtttagttgtactagagacaagtagttaggtggttactagattctgattcgccgctatatatcgtcattttatctttttttgaaggagataggtagggttataacattatccgggtaatgatttgaaaaaaaattttcaaaaaatgcgatgagatgaggttgaaaattgtaagttagaatatgcttagatagtatgagtatttacgttggtaacttgggtttcgaattggagctgtgtgcctacaacagcgtcttatatatatactatggtggtaggaactaaaaaatactctaatttggactttgtccctacaatcagtgacagtgaagacgatgttccaattctagattcttctgatgacgaaaaagtcgaggctaagaagactacgaagaagcggaagggtaagaataacaagaaaaaggttagtgagggggataacctcgatgaggatgttcatgaggacttggacgcggggtttaagtttgatttggacgccgatgataccacttcgaacttccaaggctggaactttctagcagagggcgagtccaataaggacgatgccgaagcttttgtgaagaaggacgttgacttggataagattattagaagaaaaggtgggctggtgaaaatggcccatattgatagtaaacaagaagaagaaacagagaaggaaaaagaagaaaaggaaaacgatagcgacgatgaggaattagcaatggacgggttcggtatgggagctcccatgaacaatgaagacgaaaatcagtcagaagaagaagaagaagaagaggaagaggaggaagaggaggaacaagaagagatgacgttagaaaaaggcggcaaagatgacgaaatagatgaagaagacgattctgaagaggcaaaagccaatttctatgcacctgaaactgagggagatgaagctaaaaagcaaatgtacgaaaatttcaacagtttgtctttatctcgtccggttcttaagggccttgcaagtttgggttacgtcaagccttcccctattcaaagcgccacaatccccattgccttattgggtaaagacatcattgccggtgctgtgactggttccggtaagactgctgcgtttatgattcccataatcgagcgtttgttatataaaccagccaaaatcgcttccaccagagttattgttctattgcccactcgtgagttagctatccaagtcgctgacgttggtaaacaaattgcacgtttcgtctccggtataacctttggtctggccgttggtggtttgaacttgagacaacaagaacaaatgttgaaatctcgtccggacatcgtcattgctaccccaggtagattcattgatcatatcaggaactcagcaagttttaatgtggactcagtagagattctggttatggatgaagccgatagaatgttagaagaaggttttcaagatgaactgaacgaaattatgggcctattaccaagcaatagacagaacctattgttctctgctacgatgaactccaaaattaaaagtttagttagtctttctctaaaaaaaccagtaaggattatgattgatcctccaaagaaagctgctactaagttgacacaagaattcgttcgtattcgtaaaagagaccatttgaagcctgccttgttattcaatttgattaggaaattggatccaacgggtcaaaagaggattgtcgtttttgtggctagaaaagaaactgctcataggttaaggattatcatgggtcttttaggtatgagtgtgggtgaattacacggttctttaacccaagaacagcgtttagattccgttaataaattcaaaaatttggaagttcctgtacttatctgtacggatttggcctccagaggtcttgatatccccaagattgaggttgttatcaactacgatatgcccaagagttatgagatctacctgcatagagttggtcgtaccgccagagctggtagggaaggtcgttccgtcaccttcgtcggtgaatcatctcaagatagaagtattgtacgtgctgctataaagagtgtagaagaaaataagtccctaactcaaggtaaagcacttggtagaaacgtagactgggttcaaatcgaagaaacaaacaaacttgttgaatccatgaacgatacgattgaagatattctggtggaagaaaaggaggagaaggaaatattaagggctgaaatgcaattaagaaagggtgaaaatatgttgaagcataaaaaggaaatccaggcaagaccaagaaggacatggttccaaagcgaatcagataagaaaaattccaaagtattaggtgctttatcaaggaacaagaaagtcactaacagcaaaaagagaaagcgtgaagaagctaaggcagatggcaatggtgcacgttcttatagaaaaaccaaaaccgaccgtattgcagatcaagaaagaacttttaaaaagcagaagagtacaaattcaaataagaagaagggcttcaaaagccgtaggtaataattttcatcgtcattatcataaaatatcaacatacttatcactgtcattatattattaatactttgtatttaaatatcattaattcatctaataaacaggggattagtcaaaaattcctttttttttgttgaatctgtagaagtgagtattaataaactgcaagctatatgctatattaaaaggatttttcaagtacaaacgaactgaatggagactcaagctacttgcgggaaagaattacaaaattacattccattctagtaaaaaaaagttataaaaaaaaaaaaatcgtctgacgacaaacttgtatcttaatcaaaataaaaattttgggttactttctttaacgtttccaagttataaaattcttcatcttcgtcctcgtcgcttggttcaggtggaggcactatgatgtcctgacgaacgttcaaatttatcatctgaacatttttcctcaaatcaaataaagtgtctatttgttctttcgtgtcttctgatatatcttcatgctggaatggagatatcaatttcaatccgtctagccatatatatcttccctcttctgtgtctaaataaaatttcaaaactgtcttgtcgttacgatcttttaattcaactccagtgtacacattggcttcatctaatttgatgtaaacattactgcccgtccgacgactcggtgtagtaagttctatgcttttgaaagaggttatatgtttcaaaacaacaacttttgttctgccattagctaatgcctcagaacctggacttgttaagattttattgtcgaatagataaggtaaatcgtttgtttgtgtttcgaattctctggctaataaatttgcgtggttatctgaaactatgaggaagtagactttaggcgtgccagcttcaggattcagtgggttctctgcgtaaacccacgttcccttttgcaattgaagaagtctttgatgacgaacgtaatcacgaacctggcctgatagcatggtatcgaagctagcgatactagatgaccaggttcgatactgttcttttttaattgagtctaattgtaatgttcttgcaaatttatagctcatagagtcaagtgcaacaacttgggtcttgagaagggatttcgtctgtattgctgcttccaaatcactggatgacaaacaaacatattttaaagtgataatagctaaatttaacagtgaaaccaaatcactttgcgattttgctaatgattctatccaaaatctcaaaaacaactcgagtgttttgtaaaaacatgtttgtcgattgagaacagcggtagcaatttgtaattttaaatcacgctctgagtctgagtattggttctcttttttcccacttagattgaaaagtcttctaaattggtctgaaagtttaaatattgcttcataaagagggaaatcgttctcgccaaacaacaattgttcagtgtaaagtctcttgaaagacccattaggactgtttaagaatgtgaatgtatcatacgcatttaataaatttatactgggaagatcgcccatttccatttctaaccctttttggaatacggagttatctttgatggctgtaagaagatcagctttgagcgaacaggaataatcatcaatactaaccgaagatagaaaatttattagcctctgctttaacggtacaaattcttcaaggattagtggttgcaagtcttctatgtaaagtaattcagacatggaagctggaaagttatactgaaatagcaaaatgaggattctgggtacaaattctacggcgtgtgatagtgatgtctcacataatgtaagtgagcattttaaaaatagggttatgcatagtatagtgtccgtaaacaacggtatatgaataggtctttgggacaaaagttgtaaaagtattccaatgagctgagagttctctctggagatgtggcagatgctcacaataacttcattcttattagaatcttggcatttaagggctacattaaaaatcctaatgagatttgctaccaacgtttctgaccttagcttttggcaattatcacacaatatagcccaaaatcgggaatctggaattacggttttacataggtatttttcatcacaaaggaggatatagtttgccaataacttttcgtattcatcacttgtcttgttcaaatttttattactgatcagcgtatgatagcaagcttttgattgtgcactcgtaagtgacttgactggctttcctaatttaggattcagtagcacttttatgttttccaagctttcatctggcatctgcctgttatgcttcatcgcttatgccgttatttgaggttactttaatctattttcctactgatgacacaattgagtcaatccaacgtggaacgggttgcccttgtatacatttcagtttacttcttttcatgtatttccttaatagtttatttttcactttttgcctatccgtttcaattccgaagaaccgtcaacatccaataaagatcatctacaacaataagtgcccctcataattttcccaatgagatgaaagaactttgagagagtcaatataatacctgtagcctttttctgaaaatgactgatagtgagaatgaatccaccgaaacggattcgttaatgacgtttgacgattatataagcaaagagctacctgaacatttacagagactaatcatggagaatttgaagggttctactactaatgacttaaagcaaacttcaaacaactcagagtttaatgtcagtaaaaacgggagcttcaaaggtctcgatgatgcaattcaagctttgcaaatgcaaagcgtgttgcatccttcttcgttaggatcgttagcaacgtcctccaaattttctggatggtcgtttgctcaagggttttttgtaggacagctaagcatagtgttgttgttcatctttttcctaaagttctttatattcagtgatgagccatctaaaagtaagaatccgaaacctgcagcctcccgtcacagatcaaaatttaaagaatatccctttatatctcgcgaattcctgacttctcttgttaggaagggtgctaaacaacactacgagctcaatgaagaggcagaaaatgaacatcttcaagaactagctcttattttagagaaaacctattataatgtcgacgtgcaccctgcagagtcattggactggttcaacgttttagttgcccaaataatacagcaattccgcagtgaggcttggcacagggacaatatccttcattccttgaatgattttattggaagaaaatcacccgatctgcctgaatatttggataccataaaaataactgaactggatacaggtgatgatttccccattttctcgaattgcaggatacaatattcgccaaattcaggaaataaaaagctagaggctaaaattgatatagatttgaatgaccacttaactttaggagtagaaacaaaactattacttaactatccaaagcctggtattgccgcactccccataaatctagtagtgtcaattgtgaggtttcaggcgtgtttgaccgtatctttaactaatgcagaggagtttgcttctacttcgaacggtagcagtagtgaaaacggtatggagggcaattcaggatactttttgatgttttctttttctcctgaatatagaatggaatttgaaatcaagtcgctaattggctcacggtccaaacttgaaaatattcccaagatcggcagtgtcattgaataccaaataaaaaaatggttcgttgaacgatgcgttgaaccaagattccaatttgtcaggttaccaagtatgtggccacgtagtaaaaatacgagagaagaaaagcctacagagttataaatatttatgtacaaattttttgttctatctttttcctatcttctctgcctcattttggtgttccagttttggttagtgcaagtggctattctccaagtgacaatcaccaaataaattcattgaatacatattaagatcgaatttcaggtgatacgacttctccaaaaatgattgttcttcttcagaaattcctagtttgtcccttggtagccaaatttcatccgaatttctacaaatggagaaaatatcatggaaactataactttcttgacagaattggtccttcctttcctctgttagattcgacaagtattccaaagttggtatgcgttgaggcttcgattttatttgtttggagattttggagtgcgtgattactgttagagcaaagacaacaagcattatagttgacaatgtgtattgatcaaaaagagtgaacagcccgagtaaacaaaattccatgaaataaatgcccgcgtacaattgcataagggcctgtatgtacaatttaccgaacgtttcagaatagttctctttgttatattggtatttgaacaagtaactgaaagaaaagaaaaccatcgaaaatgagatgcaacataataataatataataggagcaacaacactgtatatgataccaatacagcccaacactgagaatataggataaatagatcctagttggaaaaataaagatgtctttaacctcttaaattgagcatgtggagtactccttttccatttatagtagaacaattcaaaaagtagctcttttattcttaacaagttaccgcctgcataagccatccccctaatcaaaacaaaagaacagaaaaagtttgcgcatttaggcaagtcgttggccaggagagcagggatactgacaggattgttaaggagcctctcaataattatagaaaatccagaagatattgtaacaactacgaaaagatgaatgaagacaaagacgaaataccaattctggacatcagcttctatttgcgctccagttttcaaccctcgaaggtaactcagccaacggaaaaagtagggtacgatttctattattattattaaggttactattggaatcaaattctttgccacttctcttataaatggagattggaaatgaattatttttgtaaacggtattagtgaggaaatatttggtatttgtgatattaacccaaggaacgcgacaggcaaaatccagcctataatcacaaaaattcgcaatatatttgccgagaaatatttggcacttttccaaaggggtgatgaatcgaggatatttctccaaataatgtcattaacattggggcctattattacttttaaattttgggtgggtagtctatacgaaagcaactcacctataacgtttgacaataatgttgacttgaaggtaatgaacatcttatccatataaatgtctgtgcccgacgatttatcgtcgggcagtgcctgcttggttcctgaagttgctttcaaggaatttacttggaatttaatgagtttttccttgcgtattattttatcaaggattctgtatttcctttctaatattgtttctgtatttacatacagtttagggtaatataacggaaagatgcttgactttttccagcgcagacgaatttttgtgcaatagtatgaaattctaaattgagttaaaaataccaattttttgtactgaaataatagatggtttttcaactttgaaaagaaaaatcttttgtgatttgctatcaaatgcctgtgtattgaaactcttctaaaatatttctctaaaatgatctcaaagataatttgttcttttgatttttgtaatttatttaattttatttctaatttgtggactttcttcaaattttttggaatgaaatgcgtcacgccaaagcaatcactgtgtagcggctgaaaaaaagtttctaaagaaatactttgggtaaccaatttacttgagaatccttccaaatatagaatgttttggtatttacttttcgtcaaaacggaatatcctagtcgattaacgaacctcagttccgaagaaagaaggaagtgaaaccagagtacaacaaagatactcaaaaacaagtgacagattaaagtattcgatgaattaggtgatagatttgacatggtccacttgtcaagtttacttgtcgtcctgaaactttgctcataacgttcaccttcattttctttcaaaatatccctggaaaaataatggattggaattagtattggaatgttgataattgataacactgcaaaaaagaatatcaaaagtttgagaaaccgtaaaaatagataattgtctaggccatacctttcgtttcgttcgaatttttccataggatctaacattcttccgggaagttgcttgagaaatgcaaataatgaccaataattttttatttttttcttagcaaaacaaactttagaacctggatggattttcagaacgacattggcctgatatatagtcttgaatcttgatcttaaaataataaagagtgacagctgaaataaaaagtacaaaaaagaaaacaatataccagatatgaacccttttagtgagattccagcatgtctttgcgcagatccaaatctttctttgtcttgaaatttattcagtaaattaaaagtcagttctttagtagcattcatcttcttggtaagtctttttcttgtttttgaaaaagagctcctgaagtttgtctactgtgaatatactttgcacatttgtttaatttttaaacacgctataatttgtgtcataaagaattttttgtagaatagctttttttttaataggaaaaaaaaataaaaaaaggtggaaaagacaatcttttccagaaacttgaaactatactggagatgattacgagacaggcttgataatttcacaagagtaatgtttcattacctgctgttttattatctttatatttagtaagaccagcaggaacgctacacgtgatgataatggaactaagcattctgttagatggtaagaattttttttaccttccattaccactaacgccttttttagtgtctttttgatatttactgacgtatttttccgcaccgtaatttgaagaaaaagaaaagtgacaaaagatggcattgtttacatacagagtcgtagtatcacaagagtagtccaacaggatgagtgaccttaaccaatccaaaaagatgaacgtcagcgagtttgctgacgcccaaaggagccactatacagtataccccagtttgcctcaaagtaacaaaaatgataaacacattccctttgtcaaacttctatcaggcaaagaatcggaagtgaacgtggaaaaaagatgggaattgtatcatcagttacattcccactttcatgaccaagtagaccatattatcgataatattgaagcagacttgaaagcagagatttcagaccttttatatagtgaaactactcagaaaaggcgatgctttaacactatttttctattaggttcagatagtacgacaaaaattgaacttaaagacgaatcttctcgctacaacgttttgattgaattgactccgaaagaatctccgaatgtaagaatgatgcttcgtaggtctatgtacaaactttacagcgcagctgatgcagaagaacatccaactatcaagtatgaagacattaacgatgaagatggcgattttaccgagcaaaacaatgatgtatcatacgatctgtcacttgtggaaaacttcaaaaggctttttggaaaagacttagcaatggtatttaattttaaagatgtagattctattaacttcaacacattggataacttcataattctattgaaaagtgccttcaagtatgatcatgttaaaataagtttaatctttaatattaatacaaacttgtcaaatattgagaaaaatttgagacaatcaaccatacgacttctgaagagaaattatcataaactagacgtgtcgagtaataaaggatttaagtacggaaaccaaatctttcaaagctttttggatacagttgatggcaaactaaatctttcagatcgttttgtggaattcattctcagcaagatggcaaataatactaatcacaacttacaattattgacgaagatgctggattattcgttgatgtcgtactttttccagaatgccttttcggtattcattgaccctgtaaatgttgattttttgaacgacgactacttaaaaatactgagcagatgtcctacattcatgttctttgtcgaaggtcttataaagcagcatgctcctgctgacgaaattctttcattattgacaaacaaaaacagaggcctagaagagttttttgttgagtttttggtaagagagaacccgattaacgggcatgctaagtttgttgctcgattcctcgaagaagaattgcatataaccaattttaatctgatagaattatatcataatttgcttattggcaaactagactcctatctagatcgttggtcagcatgtaaagagtataaggatcggcttcattttgaacccattgatacaatttttcaagagctatttactttggacaacagaagtggattacttactcagtcgattttcccttcttacaagtcaaatatcgaagataacttactaagttgggagcaggtgctgccttcgcttgataaagaaaattatgatactctttctggagatttggataaaataatggctccggtactgggtcagctattcaagctttatcgtgaggcgaatatgactatcaacatttacgatttctacattgcgttcagagaaacattaccaaaagaggaaatattaaatttcataagaaaagatccctccaacaccaaactcttagaactagcagaaacaccggacgcatttgacaaagtagcactaattttattcatgcaagcaatcttcgcctttgaaaacatgggtctcattaagtttcaaagcaccaagagttacgatctggtagaaaaatgtgtctggagaggaatttagataaagaatgcacggataaataagtaaataaataaccatacatatatagaaccatagaaccacgtttttgtaataaacagtctacgtgtatctcatcatttttctgtgttaactattattattattattatcgaatggagggtaatattatgtataggtaaaataaataaatagtgccatgatgcgcgaagattggcaatgggaaactcaaaaaggcagcaacaaaaaaataaaggtggcatattaatcacaatctattgcctatatgtgctaggttatgggcaaattcggcacgacaaataaatcaacggagaatcttctgcgtgataaattcgtacccgagacatctccaactaatattcccactgatgtactcatcaagcaagggcaaataacggattccaccgaatcactaattcatggaggcgcagaaaggtatattgttaacgctttaaagcctatagaattaaataaaactgaaggctttttcgaagacccgccgttccatcttccttctccaccggttgactcgacaaatctggagtatgaagacgttaccgatcctcctaagaatggtttacgatatgatttgaatgatatatccgttgaggtaatcgaagatttataccgccagattgaagcttttttggttcatttcaaactatccagaagttttttacaaattttcaaaaactatgtcaatattcttattcaagaaggcatcaatcctttacgcgatgagtacttcacaatattggaagatgaactgaaaggttttttcactttcaattctgttatagaagagattttagagatatttttaatccaccctcgcaacaaattcattgcattgtcccttgcagaatatacctacgctaagaacaaaatcagaagacattttaatcactggaagactgtatgtgaattgaatgaagaggcaaacaggtttgcaaatcaagcaaagctgagggtacaggaagccgtcttctatatttggagtgataaaacattaaaatactcacagatggccaacgatgaagctgaaagttttaggaatacttggctactatttcgctcgttccaacaatggataactttaacacaaactcttaaggagcagtcaaggttagcagatcaggcctttttgaataagatgtttaggaaaattttaaaggcacaagagcattggaaacacttagaaactgttaacactgacaacattaagaagatatttttacgaacaacatttcatatatggaagctaagacataaagaaataaactaccacgggttggaaagaaggattttcgaaagaataaaacagaaagttataaactatgaatacaataagagcattgcagaaaaagtgaggtcgttttctctacaaagaaaatatctgaataaatgggaaaagaaaaacattgaaaacgaagataaacttggggcactttatgagctggagaataaattcatcaaacaaaagttttttcgcaaattaaaccggtcatttcaacatagtcaacaagaggcaattgcaaagagtaaactaaatcagacacttttgaggtgcgtttttgagaagatgtggctgaaaagattcgaagaccatctgcatttgtattcaattgtaagtctaaaagaggctaacctcgtgaagcgtatttttcattcatggaaaaaacttctatatattgacctcaaagcaagcgattattcgaggactaatttgctcaagtcatcattgcgaagttggaaacttgaagtaaagttaaaaatatttgagcagaaatgtaaaaagagtattcaagcaagcgcgtatcgtacatggaggaaaagaatacagtatgggaaaatatcgagcgaacatgttaaaacggcattttgtgcaaaatatcttgatgtgtggaaaaggaggatgctacaaatgaattctatgaatgacgaagcatccaaattttacgaagagggtctcgtaaatgagtgtctagctatatggaaagaacgcctgattaaaactaaggaattggaggatagatacaatttcttatgtaagacacatgcaattttgactgtaaaacggacgctaatgcatattgataatgttcatttgctatatactaaactggcgccctctatggatagaataaagctttctaaggcctttttaaagtggcggaaagccacaaggttcaaagtcaggcataagttaaacgatattttacacgtttatgaaaagagtaaagagcgcgaacttcaaagccaactgttcaacgcttggcgaaatagattttgcttctacacagaagaatgtaacattcaggctatttcaaagagaaactaccagcttgaaaaaatggtgctgaagaaatttagagaaagacttttagagatagtaaaatcagaagaattagcagacgaagttcgcgaagaatttgtgttagtcaagacgttttatatttggaaaactcatctagacgaaatattttatatgaatacattattggaacaatcggaagctaataaacaattcataattacatccaaattcttgaaaatgtggagtcttcgattcctaaaaattaagcgtaatgatgagacagtcgaggtttttcgtcatcggtgggacagggccactgtaaggggattgttattattatggaaaaatcgttcagacagttctccaaagagaaggaaggacttcaatcttaaacatgaactaaaaactcccataagatcagactctcaaaacgcctcaaccataccaggctcagaaagaataaagcagcacagaatggaagcgatgaagtcgcattatagcagggcaagaagagctataccaagtccggtgaaatcttctagtgttcttgattctacagctaaaaaacagatcaaccttgaaagtacgacaggcttaaacggatctccgacgcgaggaaaacctctaaggtattctcctaggcgtaccactagaaatatgccatccaaagttgaccaaattgattttggtagaatacccgctgtaccttttagcctaagcgccaattctcctaaaatcgatcaagatatggattatataagagagcatgataaatccccgttaagtcgtaaacgtcaatagatatatatattatgtacgtatgtatgtgtgcatatgtagtcgtaacctttcttgcttctgagatgcatacaattactaataatattctccaggtctataaaaacatcacaacatactatacttttcgtgttcgcgttgtaagctataatggaaaatggacgccataacacattacttaacaaactacagtttgtcaatagagttgtccagtagagttaaaaggtcaattcaaccggtcttcaataagacatgtcactgaatgacttcctaagttccgtgctacctgtcagtgaacaatttgaatatttatcgttgcaatctattccgttagaaacccatgctgtcgtaaccccaaataaggacgacaaaagggtcccaaaaagcacgatcaagactcaacacttctttagtctatttcaccaaggaaaagtttttttttcattagaagtgtatgtgtatgtcacactttgggatgaagcagatgccgaacggttaatatttgtatcaaaggcagacactaatggttattgtaatacgagggtaagcattagagatattacaaaaataatattagaatttatattatcaatcgacccgaattactatcttcaaaaagtaaaaccggcaataagatcatataagaagatatcccccgagctgattagcgcagccagtacgccagcaagaactttaaggattttggctagaaggcttaaacagtcaggcagcacggttttgaaagaaatagaatctccacgttttcaacaagatctttatctctcattcacctgtcctcgtgagattttgaccaaaatttgtttatttactagacctgcatcccagtacctcttcccagattcttcaaaaaacagcaaaaagcatatactaaatggcgaggaactaatgaaatggtggggctttattttggatagattactaattgaatgctttcaaaatgatacaaaagcaaaattaaggataccgggcgaagatcctgctcgagtaagatcatacctaagagggatgaaatatccactatggcaagtgggtgatatatttacctctaaagaaaattctcttgcggtatataatattccattattcccagacgatcctaaggctagatttatacaccaattggcagaggaagatcgcctcctcaaagtaagcttatcatccttctggattgaactacaagagcgtcaagagttcaaattaagtgtcacatcatctgtaatgggtatttcgggatactctcttgccactccatctttatttccatctagtgccgatgttattgtaccgaagtcaaggaagcagtttagggcaatcaagaagtacattactggagaggaatacgatacagaggaaggcgcaatagaagctttcaccaatattcgtgattttctattgctcagaatggcaacaaatctccaatctttaacagggaagagggagcatcgggagagaaatcagccggttcctgcaagcaacatcaacacgttggcgataacaatgctaaaaccgcgtaaaaaagctaaagccttgcctaaaacttgatacatattgatatttattatttagtacacgtatgtagcatcgatcttagaaaatgcatgtttgtatttattgttagtaccttgatcgccacctttctaggtaatgataggtcctcaacttttactacgcggtgcacgcctgtaaggtcgggcaaaacaaagtgtgggaacaataaataagagggtaggatgaaatattacctttactctactgctcaggttggccacaatttgctaaagagtttatcattaagtagctaccagcgaatctaaatacgacggataaagaatggctagtttagaagatcttattcctactgtcaacaagctgcaggatgttatgtacgactccgggatcgatacactcgatttgcccattttagctgttgttgggtcacaatcctccgggaaatcctcgatattggaaacgttagttggaagagattttttacctaggggtactggtattgtcacaagaagaccgttagttcttcaacttaataacatatctccaaattctcctctaatagaggaagatgataactcagttaatccacatgatgaagttacaaaaatatcaggattcgaagctggtacgaagcccttggagtataggggcaaggaaagaaatcatgcagatgagtggggggagttcctgcatataccaggaaaacggttttatgatttcgacgatatcaaaagagaaatcgaaaacgaaacagcgaggatagccggtaaggataagggcatcagtaagattccgattaatttgaaagtgttttcccctcatgttttgaatctaacgctagtagatttgcctgggattacaaaggttcctattggggaacaaccacctgatattgaaaagcaaatcaagaatttgatcctagactatatagccactccaaattgtttaatcttggccgtctctccagctaacgttgatcttgttaattctgaatccttaaagttggccagagaggtagaccctcagggcaaaaggactattggtgtcattaccaaattagatttgatggattctgggactaatgctctagatatcttgtctggaaaaatgtatcctctgaaattggggtttgttggtgtagtgaatcgctcgcaacaggatattcaattgaacaaaaccgttgaagaatcattggacaaagaagaggactatttcaggaaacatccagtctacagaactatttcaacaaagtgtggtacgcgttatttagctaaattgctaaaccagacattattaagccacattagagacaagcttccggatattaaaaccaagttaaataccctgatctctcaaaccgaacaagagctcgctagatacggtggcgtaggagctactactaatgaaagcagagctagccttgttcttcaactaatgaataagttttctacaaacttcatttcatccatagatggtacatcctccgacattaatacgaaggaactctgtggtggtgcccgtatttattacatttacaataatgtttttgggaattctttgaagtcgattgatccaacttctaatttatccgttcttgatgttagaacagcgattagaaattctactggtccccgtcctacattatttgtacctgagttggcttttgacctattggttaaacctcaaattaaacttttactagaaccatctcaacgttgcgtcgagttagtttacgaggagctgatgaaaatatgccataaatgtggctccgctgagctagctagatatcctaaattgaagagtatgttaatagaagttataagcgaactacttagagaaaggttacaacctactcgctcttacgttgaaagcttgattgacatacatcgagcctacatcaatactaatcatcctaattttttaagtgcaacagaagcaatggatgacatcatgaaaacgcgtagaaaacggaatcaagagttattgaaaagtaagttgtctcaacaggagaatggacaaaccaacggtattaatggtacttcatctatatcttcgaatatagatcaagattctgctaaaaacagtgactacgatgatgatggtatcgacgcagaatcgaagcaaacgaaggacaaatttttaaattatttctttggcaaggataaaaagggtcaacctgtgttcgatgcatcagacaagaaaagatccattgccggtgatggaaatattgaagattttagaaatttacaaatatcagatttttcactgggcgatatagatgaccttgaaaacgctgaacctccactgaccgagagagaagaattagagtgcgaattaattaaacgtctgattgtttcatactttgatattataagagaaatgattgaagatcaagtaccaaaggcagttatgtgtttactcgtcaattattgtaaggattctgttcaaaacagattggtaaccaaactctacaaagaaacactgtttgaagaacttttagttgaggatcaaactttagctcaagatagagaactatgtgtgaaatcactcggagtttataaaaaggctgcaacccttattagtaatattctgtaattgcataattcatctcatttttgatcttacttcaacattgcgggcgtgattataggtcagtgtttattcctttactcagttgatggtttcaaatgtgctctcctctccattctttttcttgttaataaaaatccataactaaataaataacaaatattagcaatcgcaaaagtattaactaagctagaaaaccttcactagaggagctctacctaaaggtatagaacaggaaaaagtgtttttattttggcggacttcgtggaagattgccatccaccaataataagcgtagtccataggtacgatcatttcctttttaaccgttaagcaagagataagatgtattttgtttaccagcgaatgctcttatttatcttccaggttccccaaaaaatacaaacatatattaattattgtccttgtctcgccgtatttatcattaatataataggaactattgtctatgctagtaaaataaaatactgatttcaaaagaaaaccttgagaaacaaatgactttcagcgattacaaaatacgtactctgctaaattggtgtggcgccctaaagtaaaactggaaagaatactaattaatagttgaccactcttctgtgcctttccaataatctaattatcaatgctacgaatgattatagttttaactagatgaacgaaatttctaggttattaaagagtacgttatgcatcaaaagcatatcagtcataatgagcagatagaccttctacatggtttgtagacaaccaaactggtgtatgctaatatcaacgagtaaacgcttacttttctaaagttgaatatttgaagtacacacccgcgtaaagagtttttaccccgaaaacaaatttttatgcttgaaaaatagttaataaaatttttttaatgttcggataacaaatacaatagttttattaaaaaataaacattatttaaaaatagtaatttaaattattattttattttaatgaactttttaataatatttattacacgtgatttaatatgtcctgtttttttttcatcattctcctttttttcttatgttaacctcatactacaagttttctccttataaaaagctgacaaaaattagagaatgataatcataaataaatttagtagccatttccactttacattttgatttaatcaacactcaaagttcttatttgaaagctagtttagaacttatttgctccttgatgaatataatgaaaagaaatcccactcagattaaatatgaagattgttaacggcaagacgctaaaagaaaaggaaaggaagtagatgatggaaaataaggtcactttcttgttagttacatatactttcacagaaacttgaaaataaccataaaacttaaaacgaacgttattttgttcaattgcttaatttgtgaagatattatctactacttaaatgatatattaacacttatgaggtactgacactgcgaccgcccttttgatctgatcccacccttcgtatatctctggggctttgtatagcgttcacagaatatgaaccttcaaaagtgggttgagaaagtggtgataaatgcgctgttgccgagtaagaagggttgtggattataggagagtgttgaatcagtggtgttgttgctcgatcatttctccctctttgatttttgtctttcacttttccacccctggtaattattatgcaaaacaataaagaaatggctatggtaacacctattataaccccaaatccaaccgctatccctggcaagcgcagatggtatttctcgttgtttagccaagataaggatatgggtttgtcgatcagaaatatgcatgaacttttcaaattagtagtgcatcctgttttaagaattctaacttccttggtccagtcgccctgtatgctaacaaaaacgttgtccagatgatcttttctgcagtttagttttgtacctagtttagtgctaatggagccattgcagtctagtaggttttgcgttacattagcaggaatcaaatggagttcgaggaattttcttaagtttgtcgagttcgccgtgatgccacttaatggaatagaagaagccgttggaactaaaagcgagtactcttcgttattcctaatgattgaagaaaggtcgtcaaacaagttaaaaaagtcaaatatttcttttgttccagtagtttctatcagctcttttagggatatctccaaatcgactggaaaatccaattggtctataggatggataactccctggttgaaaaatatatcggaactctcctcaataataatactttcctttatagtactcactgagattttcgtaaggttttggcttcccacaattttttgtacgccaatagatacagagtttccgtataaattcttgacagtagtcgaaatactataattgttggaataaataaggtcttcgaagattaggttcctcataagtaaatttagggcggttttgtttgacctcaaatagtctatagtcaaatcattattgtcccatgaattcatacatggaagaagtatcgtgtaccccttatgatttgatggtagatccaaaaggttaagttccttcaagagcattagggaaatagaacagtggttttctggtgctaacgacaacactaagtcgcccggtaattgaagatcatcgtcaatagaataaatggacgtattaccaatctcataaggttttgtgtttaaaatcttgaagcgaccattgatgtaataacctttattagaccttgtgattttgaacttttggcagtgtccacctagtcttttagctgaagagcaaaaggcggagtcataaatttgggtaggtgcgtattgaatcgggcgcaatgaggaaaattcctgttcaaggtcaattttaccttctacaaaatggtacagaagtgatggttttgtgtacccacgatcctcattaaaagaggcttgtggtacaaatatggtgattttccttccgttttgaatgaatttttcaaggtctctgaagtataactcctttacgaattctgagcagttcaaaccgtgcaagtacttttcagcatcaaactgtatatgcgttcgtaaaaagtctaagtcagaaaatccatgcacgacgcctatttcaaaaattctgtttgatatgggtgagtaatctgaattatttacacttactgatgtaccttctgaattactcttcataaaaagttttcgactgtttttattttctaaaattagttccttgggtaaaataccaccatacacgtcatcaataatgagttcttgaagaagggaagttctatctgcggcccatttggcctgagaaattgtattagatttacccaatttattatatttgtcaagtagatagtttatttcgattgtattgaagaattttcgaaaattaacatctaagggcactaaaactgtggatgagtttgtatatgcattatagtttgaaaaactgctgataaaatcactaaatatctttaaatcttgggtttcttcgtctagttgtaccagcaactcatttatttgaggttgaattagtaaaagattgttaataccttgtaatgaagcattctggaaactaggcagcaaatcgggttcgacaacagcaatttcattgacaaagcaatggcgctcatgctttctcagcaataaaggtgcttttgcagctcttttctccaggtaggtaccgttttcaaggtctctcacttgcaataccctatcatgaataaggaaatcttcaatatggaaatgctcctcaaattggtctgtggtttggtcccccttaataaatgctgaattaatcggagcaaaaagtgtaaagttctgcagctcatttaagtactgtacgtgaccagttttctgaataatccttaaaaaagttgagaattcaacattttctgagaggatatctattactgtgctaaatggaaaatcgtcccctgggttttgtagaagtgcttgtgtaagccctaatatcggcagtagccaaaaaatgtatttaattgtttggattgccatgttcatcaaagggctccgtttgattcagttaatacatgctgtcactcacagcagcttagataagaagccgttttgtcttattttctaggcccttaatatacgcctaatggggaagtccgaccgaacaaaattctcctaccgggttttcacggtaatgttcttccataaaaaaagacaatatagtaagctgttaatattgatttggtgaacttgaatctgatatttgtttctattgcttacgtataatacttttgcggtaattcattcaaatttcatacaatgctaatatttatacaattctactcgacacggcaaaaatgattggctaacgataatcgcggctctttatatacttaatatataggatctagctatttagaacactctttagatctagatgatagagagcgtagcccctttgtaactacaggacaataatgcttttcaagaagagcattatcccataaggttgctgcctctgggttactccttgaaggattatcggcttccattatgaaatgaccgttgcctattctatcttcggaagagtaaaggcctgaaatttctggatatctattcattaatttatcaataaatttaagaatggcaatacttgttttttctggggtatggctgatgcacatgtacaatcttttggtaaacgccgtagccctttctttagtccctgatttagagcggaaaaatatatggtccagagcctttagcagaagttctgctttggtagaaacgttaactgatggttttattatttcgttattgagtgggtcagccaaccttagcgatctataagataattcgatgtctgcatcaagacagatataaggtaatagcgcgtaaagcccatcgacgaatttggacaaatccacattaactttcatatattgtgtatttgaaataagtgagaatgcactaacgatacaaagcaaagccttacggacctcagcagaggaaaggttatcgaattcagtgtcactaataagttctttcattacttcgaggaagtcccctaatagatcaaagttggccatattaccaaacttcgttagaccttccaaaaccgatccaatgagtgtttttgcattgtttttcaagatattcaaatatatagtgaaaacgatttttagaatttcggattggtttctttctctttcctccgcagaaacagcttgctcagcgttacgcatttcttcctcaatttgttgcatctcttttcgagcttttctttgcttcttagaaagatggaccctatctttctttttgagcttaggagcgctaacgttacctttcgatttagtattagggtcatagtcatgtaagacatctaacgataataacatatttaaaacagattcttcgatgttgaagttcctcgtctttagtattttgttgaaaattcttagtatctcgaatgatattgagccctcttcgtcctcatttaatagagtttcaaatgtctggattatttgaatggaagttggatctgttgaaattcttggtttacaaattctacgcaacagtaaagtgaaaatgtctgttctaaagttgaaatgggatgccgttgaaatcaattcttttgcggcttgagtggccaaaatccctaatgaaacctgtataggagcagcattactgggagtttttgaaagactctgtaatcttccgacgtaatttttgtagtaataaactaaggcttgctcaaagtttctaagcttggagacttctttagaaactttttccttcttttcagtttcagttagtggtcgaattctatagcctggtatgatactcttaaacacggggaccaaagccaacatggaaaacttacaagtattaggatttttagattccaccattttacatagacgccccaacgcagcagtattttcttcaggctcctccataactttagtgactaaatcggcaatgtcttcttttagttgcagaattttttcctccgtatcaggctcatcctcctttgcctctgcttcttgttcttcattaggtccctcatcatcttctgaagaatcattagagtcttcgtcttcctcatcatcgtcctttggtttttcttgggctttatgcaattttctttcaactttaccgttaacttttataggcaggccttcaacaagatttgatgtatcagaccgattcttccgaggaaccatttcgtaatcctgttcttcttcatcccaggatgagccttttgcgctatatatggtattttcatccatatcttccggtgcattttggaaaacattgccttctaacaaggaatcttcgtgctttcttttctttgcagtcctttcctgaatgcgaaattgagatctatttctcttagccattattactatgatatctccagcttttatcccggaattatactcttatgattgaagacataaaatgccaagtttataccatgaaaatactatatatggcaggcaggtgaatgagatgagataaaattttcagttttcgggcatcgctgaaaaaattcaaaaactaaagtaaaacgacgtcccatggtctactctacggtgaagaaaatgagggaagacattgaatttctgaatctaagtaactacaaaaaagcatacactccatggaaagagtaaaataggataaattggttttatgtagttaaagaaaaaatacattgttatatatggagtttgctgcgcgcctaggcgttctcgaagtttctcctttgattttactttttggaagggctttggacaatttaaagaagataatttgaagtaccccatcaaatgctagaatgaaatatttaatatactaaattaaggctggtatttaaaaacgtaatcttatgtgtagaacctcagtgaaaaagcgctattattaatataacagtattttcacggagctttttttattcaaaaaggttttcaagacttggcagaggacggctgcattctcgaatgataatatagtattatccttaggatctaaataacttgcatcaagaatgatatctaacttttccttaccttggaaaagcaagtcagtagcttctataattttctgcattcttgttggagtggcaataaaatatagtgaatctttatttttgtttgattttttagagctgtcagtaagtaaacgttccacggtggctatgtcatcctttagtttacttttagagaataatttgacgcaatttttgccaccgtttagactacgataaacgtctgctactctaatattagacatagaaaaaacaattttttttggagctacggaaaatttttgaataaaggctgggaaattgcttaatctgcgttcagcgtcaaatttttctgtcgaaagaaaatcatttcttttgaagtaaagttcctctaattctaaaacactcaagtcaggatttttttctcgtatcaaagttgttaggtactcaataattttttctggtgaacttgctggaagtgcttttcgttgtgagacgatatactggctttcctctttctttttctcaattagctttgattttttctgtagctttttctgtcttttcgaaataggtctattcgaatcatcttctgaatttctctcctcttttttcccatctatatcatcaacgtcatcttgttctatagacctcttttgtacctttttggttgggggactaccatccttggcgtcaaaaattacttcatgttcggcatcaaaatcataggcgagtccatcatctaaatcatctggattagacattttcagctcaattgtcctgacgttatgtttagaagttagtagcggggatcaaatctcgactttcattgcctcatctatggtcatctcaaaaattttctcttcaattttttggtaaataccaagtgcaatgaatgtttgggtgtctttgaatattgaatattacagactaaaaatattatatattgtaaattaaaagttgattattagtaaatgtacctgaaatttctgttttcgatatcagtcaagtccaaaaattggtacttcttcctttcttgaccttcttgttccttatcacgcttttcgttctccttcttgcaaatgtagccaatgtataattgtaggggaacacaaacacactgagtgaccaataaggcaatctttgctggtatgtaacgtggagctgagtatgccctaaacatctgtggagcaataatacaggagacattgtatacaatcattgtaatagcatttctaaaaactcttttggtgtaaccggaggtgttgcatgaattccagatgtaaatattggtaatgacacaggaaccactgtaaagcaagtacagagaaaataagttaccgatcttatgggataagggtaaactgataagaacgatacaacctataatagctggaatatacatagatgtggttatgagtgtgatatgaccccagcgggacaacatttgagttgttataagaataatcatagccgtaatggcaccaataggcaactgcagtaatgctgtttcgtacttgtcgaaaccaaaagtaccagtgatggtcactgaaaatgtaccaatggcaccagtagaaatttgagaacatgcagttaataaaagcatcggccaagtaaacttatcatgaaggaatagttctttaacttgctgcttcttaaacttctttgtttccaggccagtttggttagctctgatatgctcaacaacttgaattttttcctctttgtttaggaaccaagcattggtgacgttatctggaaggtataagaatgttagaacaccaaacgcaactgtaaccagaccaacgaccaaaaacattatttgccaagaggtgaaagcggtaccatgataatgtaaaaagccaaaagaaattaacccgcccacaatataacctgtaccagcctgtgtggcccagaatccaattcttgcactctgttcagatttagtatagtacataccactaatagcgatacaaccaactgcactcgaggattcaaagagacctaggagagtacgaacgaccatcaacgaggcgtacgtcttacaagcagcatggcaagccaacacgataccccagacggtaataaaagtacctaggattttggaaatggggaatttttgaattaagtaagtgaccacaggttccatgaaaatgtaagcagcagaaaagatagtacccaaattagaaaattcgttacctttcaaatgatctttgatacccatagatgcagcgtagttcagcagagccttatccaaaaacatcagaagatatgtacagcataaaaagggcaggatgaagaggtccacttttctcaggaccttaggagataattcatgggaaccatagaagttggcttcttcgcctgctacaacatcgtcttcattagccgtggagctttcgtcgagaccgttctgtttcaggaatcttaaagcaacgtccgcatcgtctacattaatgctcgaggtacttacggaacaactatcagcgttagctgccttcttctccacgtccatggatcgttgtgacatgtttttcattgtattgatttgctgacactctcactacttctcagcaacaacaaagtaaactttaatctatcatactttgaactatcttatatacatgtatatatgcacccgctgagatgctcatcgagattgctcatcacctctgaaaaggctgtctgtcaccaccatgttttcggccggaccaaatgacagttccttaagggaaactcaaagagactatattaactaaggaggatcaaccagatatgcaaaaaaaacaaatagttatgacggcactcgaaccaaccaaacaccaccctataattaatgttgataatgatagcgactcgaaatttgccaataaaacctgtctattacgcgtcatctacttgagagtaatatactggaagttcgagatactccgcacagggtctgggtggtaggtttctttgctattgtatagtttttcaagatacgtaaaaggtcttcatcttatcttatatagatgcaggtgattactagtggggcaagtcggcagctaattgcgtgtgtgcggaaggattgtgcagtagaatggctcctgcagttatttcagaatctgaagaggatgaggatagagttgccattactagaagaactaagagacaagttcattttgatggcgagggagatgatcgtgtagaccaacagcaacagcagcacagttcaagccacagggatagggataaacatgtgcagcgtaagaagaagaaaaggctctcgaatagaaacctgcaaggttcaaatggtgggtacgcttgggaggatgagatcaagagaagttgggatttggtgaaagtggacgatgaaggggatatggcatctcttgtggctagcatagtcgaggccagaaagaaacgtactgctaagaaaaacataacgccataccaaagaggtattatcagaagtttaatattaacactagattgtagtgaagctatgttggaaaaggatttgagaccaaacaggcatgccatgattatccagtacgccatagattttgtccatgaatttttcgaccaaaatccgatatctcaaatgggtattatcataatgagaaacggtttggcacaactggtcagccaagttagcggaaacccgcaggatcacattgatgcgttgaaatccatcaggaaacaagaaccgaaaggaaacccttcattgcaaaatgcattggaaatggcaagaggccttttattgcctgttcctgcgcattgtacaagggaagtactgattgtatttggtagtctttccacaactgatcctggagatattcaccaaactatcgattcgttagtttctgagaaaattagagtgaaggttttggggttatcagctcaagtggccatatgtaaagaattatgcaaggcaacgaattatggtgatgaatccttctataaaattttactcgatgaaactcacttaaaggagctatttaacgaggctgttacccctttacccgttaacaaaattaataagggtttcacactcgtaaagatggggtttccgacaaggatattcgaagatactccaactttttgttcgtgccattccaagttagtttacggcggatacttctgtcccaattgtcatagtaaagtttgttcattgcccacagtctgtccatgttgtgacttgatgctaatcctttctacccacctggccagatcatatcaccatctgatgccgttaaaaacatttgcagaagtacctacaacagaaaaatttcgatcagaagactgctttagttgccagtcaagatttcccatactgaaaaaccataaaaatggtaaactactgacaagttctcgctatcgttgtgaagattgtaaacaagaattttgtgttgactgcgatgtgttcatccatgaaatccttcataactgcccaggctgtgaatccaagcccgtaataacttaacgaaaatctgtcagcgtataacacgatcactcttccatcatataacaaatccaagtagtagagaacgaaatagtttttgatggacatataactacataattattacaaaaataacctcatttaatgtcctattgtttattacgagaaaatcttaatagcacttacggcattaagaatatttattactattttcaatttatcaggcacttattcaactaaaaaaaaaaaaaattactttgttttacaataatattaataattattttgaataaatatcgttacattctatcataatgtcctctacacggtacaaccaaactcacaattctatttgagtgggcgagaggtttgaattttttcttactgggctgtgtgtaggggtcatagatgtcgcttgtttgaatgagtgagggttggaaggtgcaataggtttctgtggagatttaaccaaaacactgtcggtcatccggctttctccctgcttccagctgtcaaaatcaatcaaggcttgcatacatccccactctgtaattttcttactaagccagtgtaaattcactggtttagtcaggtagtcgttacaaccagaaagaagtgcttttcttttatccatctgagagttagatgcggtcaatgctacaataatcacgggcgcctgagagaatctctttgaagtacctttttcaagattggagtgtgagttattgagacttttttgaatgccaatgccattttgtttttcgaagtccctaatctgcttggcagcttctataccagacaagacaggcagctgtaaatccataaatattaaatgaagaccgccttccttccaaatattaacagcttcttgaccatttttagccagtttatatgagattttgtgtttcctcagaaaggaacctaagatagcttggttgatgacgttgtcttcaactattaaaacattaattttggggaaaactttttcacttgtggtggtaaaaaggtttggtaaaggatctggtggagaggaaacagcaaaaggtgcgttataaagcgagtttgagtaatgcggcgtttgactacttgttaatattggtgatgcgggcgtaacgtcttcttttcttctttgtacttccgacatgggttgcgttatgcctataccagcttcattaagtgatccgctttcttgcgaaggggatccggtgttcacttctaactctgaatgagtaattgtgtcttcattattgaaagatgaatccgtgtgggccactggtttatttcgaaaatctacccctcctttataaccttttggtaacagcaagattgcttgccaaggagactcggcatccttttcctcatccttcagttcttgtgacgctcttctcaattgctcttcatcagttattaatttaaattcctgagggctgctattgccatctttacctttaagatctgctttatcaccaattgtttgcttaagaccttgttcgcccggagaaatatggtcgtctagatgaaaaacaccaacggccccatggtctgttggttgagttttctgctgcgaaatttcttcattcgtaggaacatagtctacaacatttaagatatctaaaggcggtacatcctggcgtaaattaacattcgaaaatatcagcaaaggctgcgatgcaggttgggaacccatggttccgaatagttccttatatatgttaatagccaattcatccggttcaaagatgattttataagtgcaatcattaactgattctgtggtaaaatttaaaccttttctaatcaacggccttgtgtatttatttttattatgcggtgagacgtatgtaagaccagctgatgccataatttgattatcagaatgaaatttagggtagggtgagactgaggcaaatcgcagtaacggacttttagttgttgctggaaactgtttaggactagtagagtatggtctttgcgggcttagcattggcgcctcgttgggaggaaaatccacattggtagtcgcggccactgtcggcgcggcggcaaaggcgtcgtataatgctcctcttttctgcgtaggtttaggatgctggagaacattcctgtcctttgcaaggtcttttgaaagaccaaatgatcctgctgtggggctcactgaactcttggtattgctattaacggaaaggttggcgccacttccagcaccgttactcttacttcgacaactattatcgttagtgttgttactactggtattgtcggcttgattgtcaaatttaggtgcgtagaggcctattgcaatggaagcattatcgttaatttctcgccatcgagtcgaactcagtttctgaaaaaacctgctcttcaaatcatcaacagtatctatttcatcgaactgtacagcaattggttggtttacttcatcagtggagttgtctattcgtagccaaaccttccacagtaacgcagaattgagcatttttacttgtctccccaaaatcgattcgtttttgatttacagcagcctttccaatatttcttatacaaaacggccgaacttgtactcaaaataaacgctattctgaggtctaaaactaacaaaacacgtaatttttctgaataaaacaatgtctccaactagttaaccacagcttggctagtttcaatgtagtcattcctaacaaaaaggcaaccagacctatttataaatatatagccactattaaattcactagaaaaaaagtcaaagattcaatccaggggcgcttttagggcttcggaaagctgaaaaaaatagttaggacactgatatcaataatatagggaatttgaattattggaaaatggaaattaggttaagggataccaaaaaaagaaacgcgataattataggcatggagatgagaataataactatatatgtatgcggttcggtacatattcattgctgactgaagtctgatagtagtcgtggcgaatggaggtacatgaagagcaggtctctgcacctgtaacaggggatgctacagcaaaatatctgctgcaatatatcttgtcagcaagaggcatttgccatgaaaatgctctcattctagccctaatgagattggaaaccgatgcttcaacgcttaacactgaatggtcgatccagcagtgggtcgacaagctaaatgattatataaacgctataaacgtaaaactgaaccttttgggttacaagatcattcggatcaaccacgggattggtagaaacgcagtgactttaaaggccaagcagaattttgagtccttcgaagataatacagcaataagggctcacaataatgattatgcagttttgcaatcgatagtacttccggagagtaacaggtttttcgtatatgttaacttagcatcaacagaagagactaagttagccacaaggtttaaccaaaacgagatcgagtttatgaaatgggccatagaacaattcatgatcagtggagagactatcgttgaagggcctgcactggaaacctcgataattgtgaaggaagtcaaccgtattctagtagcagctacaggagactcaaacctcgcgaaatggcgtaagttcagtacgtttactgtagggtccaccaatcttttccaatttcaagaattaacagcaacggacatcgaagacttactactccgattatgcgaactgaaatggttttacaggactcaggaagggaaattcggtattgatcttcgctgtatagcagaactagaagagtgtctaacatccatgtacaatttgaacacttgccaaaattgccacaagctggcaattcaaggtgtcaggtgcggcaacgaatcatgccgagaagagaatgaggaaactggagagaatagtctgtctcaaatttggcatgttgattgtttcaagcattatattacccatgtaagcaagaattgtgatcgttgcggttcatcgctaatcacagagggcgtatacgttatttaaactaaaatacatagctttccgtgttatttacaagacttatctatacaaacatttgattgcccgaagtattttaatctcctaaacggcatgtgattgaacacggttcgaggtttataccacttgtattaggcatatatgcaattgcaataactcattttaggttcccgttttaccttatttgctaataccccttttttccaaaaagtccttagcttcgtttatcttagtggccaaaaatggagaaccacctttgtcaggatgattagctaacataattttcctatgaacctctttcaacttttttttagtcaatgtattttctgtcaaattcaaaatctgtagagcctctttagaattcattttcgggtcaaatccgcctttcaagaaggcagtagtggattttccaccgttaagtcccttcgatattgatttatatgcaccggctgtaaaatataaagttaaaaaggccccaaaacctgttatcacaggatgttctcccatgtagttcaaagcttgatcaaaataaaggtccattccggtcttttgaccctgcgaaccattctggataccgacattaacaccagctccatcaacagtaacgttcgcagagccattagtttgaccaggaatgggcagttgtggtgcctcaatagaattaccagtattactttgagaactcatgatattgtgcgggtggaagtgtttatgcaaccttattaaactgtgctcggccagtggagacgtacaaattccactactattcgtactttgtctagttcaagggtctccgtcgagtgagtcctacgttgattcaaatggctttcacatttggtccgattctcgctctttaaattttttgcccgctcgcctcgaactcagcggagtgaaaaattttcactcgtcttttattaaataatgtatttctaaactcatctcatctcatcccaccctatctccaacttacatcagtttctatcttgatccgtgatataccacttttaagttcttcgacttgtgatttgaaagatattgctattcaagcgtgagttgtccatattgttaccaccacctccccgtgatttacattcagaaactaaaaggaaaaggaagtagaagtttagtaagtataaaaaaatgagaatttatcaatgccatttttgctcatccccatgttatccaggtcatgggatcatgtttgtgcgtaacgatgctaaagagtttaggttctgccgttctaagtgtcacaaggcattcaagcaacgtcgtaacccaagaaaactaaaatggaccaaagctttcagaaaggctgccggaaaagaattggctgtggattctaccttgacttttgcccaaagaagaaatgtccctgttagatacaatagagagttagttgccacaactttgaaggctatggctagaatcgaagaaattagacaaaaacgtgaaagagccttctacaagaatagaatgagaggtaacaaagaaaaggacttcttaagagataagaaattggtcgaatctaacccagaattattgagaatcagagaagttgaaattgccagaaagttggctaaagaacaagaaagagctgaatcagtatccgaacaagaggaatctgaagaagaagaggaggatatggaaatcgacagtgacgaggaagaggaagaacaattggaaaagcaaaagattctgctaaagaacagaagaagaaatacaaagaaaattgctttttagttagaacagaaccgggctaattgcctctttcctttcttttctcatacttatttcatgggataaataagaatcacctgtatactattatttacattacataacattacaataactattttcaagggtcctcttacattcttatcaaaggtattatataatctcagtatatgccaaacgtctgacttaggagttagagatgttcagaaacttctcaccaagtggtgatttgacaaattcacagaaatcacgaacgtcattcctggatagtatcttaaaatcaatgatttcaaaaattggcggactttggtgtattccataccataccccaatgcgaacatccagtacctgcccatttatcaatctcaaatcatctttatgggctgaaaataatctttcgctcatatacaaacgcatctcctctgcgccatttgttgaattgaggcaatgaagatttctaactatcatttgacagaaaaaacctttaatgaattcttcatccgatttacagaacaagaaatctactaatcgaacaacaatcctgaatcttttggacggatgaataatgtttggttccattccgtttccaccgtaaacattgttatgaatatcgtaattcgttgctattttatccttcaaacattttaagtctagaactaactggctcatataacactgtcgtagttctctaaaaagagcaaatagagctgtatgtaaccaatacaatatagtgaattatgtcctagaataagggcattcattattctccatctctgcttcagagaaaaaaaaaagaaaaagaaaaaataacgacaactgcaggactcgaacctgcgcgggcaaagcccaaaagatttctaatctttcgccttaaccactcggccaagttgccatatgactattgatttatatcatattacgagcccaaataatactggggtgttttgacaatcctaatataaacagtcttcgagaagtaaccagttgtcaaaacggattatcagcttgattcaaggaatgttaactgtcctatatcatataaaatatgaatcatactaaatggtggaagcacggatcttggatctaaactaattgttcaggcatttatatgtttgggtagtttggctaagggaggccgggttttatctcatgttgttcgttttgttataggattgtttcatatgtattttatgaacgtttaggataatgtattgtcagactgacgtatctcattttgagatacaataatttaacctattttatgttaaatattacacaagatgataaatatgtcaactaaaaactttaacgccgagcttggccattacaatatagagcacatgctatgatcaaatgaattagatgaatacaagccaagaaagcatttttttaattacacttcatgcttttgttggaatgaaactgtaaaataccatctgtttagtagtatttgtgttaccagtataccgtcacatgcggtgtaacgtgaggacataaaaaagtcatcaaaattaatgtccccacgttacactgtatatgacagtatatactactgacatgaatactagtcgatagttaatacatgattcttattacaacatgatgattacagtctcgtcttggtctgttgtttgaccctactattttatgctattttttgtatctgatttgaattcaaggcaattgttgtaattccattcttggcataaccctgtgtagattctacagataagctgcttttttctttgagtggtgcccccgttgtttattacccgtcagtatcataacatttgagcatctcacatggttacgaatgtaaatatgaatcaaagaagatgcaaaatcaaaaaaaatcgaaagatttgacatgcctattgaaaagggaaagttgtatatctatcaattgttaattagttacttggtcatctccattaccagctgaggtgcttagtcgacaaccgcattaaacatgaaagtgggtattataatgggttctgtgagggcaaagagggtatgcccagaaattgcagcatacgtaaaacgtacaattgaaaatagcgaagaattaatagaccagaagctgaaaatacaagtagtagatttacaacagattgctcttcccttatatgaagatgatgacgaactgatccctgcgcaaataaagagcgtggatgagtatgcagacagcaaaactcgatcgtggagtcgcatcgtaaatgcattagatattattgtattcgttacacctcaatataattgggggtatccagcagccttaaaaaatgcaattgatcgtctttaccatgaatggcacggaaaacctgccctggtggtaagctacggcggtcatggcggtagtaagtgtaatgaccaacttcaagaggtactacatggtttgaagatgaatgttataggtggagtggcggtgaaaataccggtaggtacgataccgttacccgaggacattgtaccacaactcagcgtgcacaatgaagagatcctgcaattactcgcatcgtgcatcgaaacaacgaggaataaataaaccataaaatttaactgtagtcgcaataaaagatgaaaagctaacacaattatcataggacactgtaatccagactttaattagtattaagtattgagtacaaagtacaaagtattatactaacggtagtttgggctcttcgattacccatacacttttaatggactaatttcatcaagtttcattcgaaaattttcttaaaatatatatatgcgtagtggtatagtattcatatttcatgaacttatttcataaaaaaagataaagcaaacctaatatttggatcggcgctcgaaattattctcagtattcttcagcattagacatctttaacatatcaatctttaaaaggtttcttcttcttctgtagctcggaatataagcattcatatatgaccatgttgtaacgcgatcgaaccaagcaacttcttcttgtgcaaatttcctagcaataccaggcacacctccttgacgatcaaatgcaattctttcagtctcttgttcaaaatctttttgacataaagccaggtatttttcctgttgttcaggttgcagttgaagatactgctggtaggtgatttctttgtaatagacagtcttcatttgaatatgttcgagactttttctcttaatctctatgaatattttctgtcttgaagctgccgtcttcatagaatgttgttctattatccacctcgaacatggcctttttatacgtttttacattaaacatccccttcatattagtttgttctcgacttaattctactcatgcttctgacattttttcatgccaagaccggccctgaaaaagggtccggatatacggatagcgccacacattcaattaggggaagtattatttgatacattgtcagcacacagcgatttaacccattatttggcatgacaagcaagctattcgacagtgaaaaatgcacagaacattcaaaattatacttataatatgactcttttcttttattgcagttggtattatatacatatatatatatatatatatatgtatatgttccccgagacaatggttttatttccaaaaaaagtgtaagtaagttattttctgtgtataaaaaaataaaagaagccagatgaagtgccaggtggcgtaccaggacttcagctttctttagtttgcataatgaaagtatcacttacagctcccttgaaggattagacgctattaaccccgatgaaaacgcatcaacaaaacctttaacacagtacttatttggtgcaatacatactcacacaaacacctgtagaaaatccccttatatgaaaatcccttttttttcttggcaagtatttctgataaaatgcggacaacattacctgcttagccgcctgccacagaaaataagtaggcttctctgtaaaatggaataataggctagaggtcaaaaacctcctcttcagtcatatctatgtttttaagggtctagggtccaatttgatggaaaagaacaaatggtcgagcatgttaattaatatttgttgctctgtttgaagagtatattataagacgagaggttctttgagggagcttatcttaccttttcttgatttgaaacaatttcattaaatgtaaacaattatcaactagaagcaaatataaagccagaaggaagaatttgctatgaacattaagactttgtgtcatccagaatataaaagaatctccgttgaatcgttattgaatccggtagaggagacaatagactgcgaaaaacctcactctcaaacaaaaatcaatactgctaaacccattagtgcatctttgtatgtcacaacgaataatactgctgttgttcagcacaatgtccaaaagaggaaaggcgtcaccaggagatgtccacagtgtgcggtgataaaaacttctccgcaatggagagagggtcctgatggagaggtgacattgtgtaatgcctgtggattattttatagaaaaatatttttggtttttggcaaggatctggcaaaacggtactttaacgaaataaaaggtgtgagcgtcaaacgaaaagttccaaagagcctctatggagttacaagaacgcgttaagagaatttatttctgctcggaatgttatatacttatgtcaaagcagtgattatacatttatcgactttaaacagttgataacgaacattatgtgttattcgaaagtcaaagtgccatacaaaacaagtggtttctcagttcttgcaatttttctttatcagcgtagtcccagaaaaaaaaatcatcactggaaatgtaagatgaattcaagtatcaagtgccgttggtattatagtttatcaattaatacgtaaatatatatatatatatatatgactatagtggcatacttctcaatggactgttgcttctatcattttatacatgcgttcaactttgaagattatcacaaaaacctcaaacttttcaattaatctgccccggtcatttaagttagctcttttaggactctcatgttttcaaaaaatagattgaaaagagcattggtggccctactttcaatccattgatcatgattcttcgagctatcgctaaaatattccaccggattcagagttctttcctttactgatatcgtaagaagactcgccttcgtttccgttaccagacctgacaaaaaactcatcccatacagatcccgaagtaacctggaaaaggatatccatgatatcttgattattggtatacgactggcaattcaatgcagaagacgtatttgtagaagcactttcatttatcacttgattaccttcgcttacatctaaagtattaaactgggaaacattgctgtgtttttccagttcggtaaaaaattcatctagaggtatatcaaaaggtgctttttcttcaaaattggttctattaaaaaccttgttatcaaaagtaccgtcgtcaaaaccaagtacgttcgtttttttatcataacttgacatgcggtttgcctgagaggttaggggatttgaatccgaaaatatccctttggcatcatttatttgcataaattttaactttattacaactgatgataaaattttgtaactcgtgtaacaggttttcgcagattcgcaaaaacctatcagattcttcagtactatcaacactttttcagtgtactctgacactttttcttgacaatcatttatgttgttttttgagtaaaaatttacgtaaaggtaagtcatacctgtcatgaacatgttatgaactgctacccacgtgtaaccaatttttttattgacacaaagattgtaaaatacgtctatggtgcccttcgtactgtccaggacaattttaaaagcggtatcattcaaagtagggaattttggagaaagtccataaagaatgctcttcgagtaatgatagttcagatcaaaccagatgctgttaaatttgcaattcatcatctcaaagtttttgggaacgtccacttggaaccaacgctcaagctcattgtaggtttcaatccgccagctctcgagatccataaacctcctcggcaattctgcaccgggcgcgtagagtattctcactatactagcttggattcttctgattttatacatggccaatgcgataacttttgaagacggatttgggcttggtaagtctgagtagtcgtcaatttctcggttagttaatgtgatgaaggaatcgtccaaaaggctaggatacctggtggtgatgctttcttcaggtataccaaaaggtcgaccaaaatacgagcaaatttgccgatctaaggagtaaacgcaccaaaatagacgcctgcgtatttctctggtaaaggcgtcataatttttattaattttttccgaatgtagtcctaggtcaaccgttagtcttagtacagaacccatagtataccaaacaccggggacattaggtctcattattgaatagattaccatgagcaaagtgcctgccaatgcctccaacctgtctgaagatgaaaataaagatgcaatatatttagtagcgcgtctcttatatgtcgcgacagtagtaatatctgacttaagtacctgcgtagcatggccaatagcaaatataatgtttaaaaaaaaataaggtatgtgaaattttgtcggtagttcaactatcggacgcatgttgactttttgagaagtctcccaagtgtcataccatggaacatcctcggaagagcatacgtcaatcttctcagtaacgttctccctttttggttcagtatgcgcactaaaagcactggtaattggaatttcgaacgcgctatttatgcctgtctgatcagatgccaatgcaatattgggattccagggaccataaataggttcaaagtattttttcaggaaaagttctctatgcagcaaaggtaactgggaattagtatctacaaaaaacctggatatcataacttcagcggcatgtcgaggtggtagttccaatggatcaaagtgtggattgttttcagcctctgcaaatccattgtatttctgttccctttgtttaatatcttcatccagaacgtcatctccggaatcttgacgaaaattagttgccgtgaagactaatttcgcaaaggaaatacccgatgaatctcctaaaaaagagttaaaactactttctctcatcgtgcccagcgcactgatctccttattacatcggcgtagctcttccgctcttgcatctgaagtcatagggctgcctgtctcgggtaataaagcgctaccatcttgtttttttgagtttaccagaaattccttgcgttgtacatttatagtctgtgggcttgccatagacttgctcgttatagctgaggatgccatagaattccctttctgaaccaaataatccgccaataagccattatgtggcaatattccctcttctcccaaagatgaaactgaactgtactttttcaaatcaaaaggttcatcatcacttgtagcaggtatatttcctcgtattttcgtgggatctactccatattctttcaacacacgcatcatgacagccaatctatcttccagaaaaaagacgtaagatcttggaacgtcctttccggtggctgggtccaaagaaacacatggtacctctaattttgcacacctcttacagctaggaaactcctgatcacatttaatttttttcaatcgacatcgtttacatgcagttctagatttggaaattcctatattaggagaatctcctctttttgataaatctgttctattactttttttggagttaaattttttctgcttcatgatttaatcatcatcttcgtatgttttatgtactctaaagggttactcctgtgcgaataaagcaaaccactttacgttactaaaaattttcacatttggtattgtgagtattttatgaagctcatcgcggtaaaagaaaaaaatagagaatctgtgattatagtttaaaaaggatgtagacaaaggatatcagcgataaaggtggccataattggacgaagacaaataattcacctccttaataatgaagttgggtattataccttaccaggaaggtactgatattgtttacaagaatgctctccagggtcagcaagaagggaagagacctaatttaccacagatggaagcaacgcaccaaatcaagtcatcggttcagggtacaagttatgagtttgtccgcacagaagatattccattgaatcgaagacattttgtgtacagaccgtgttccgcaaatccctttttcactattttggggtatggctgtacagaatacccatttgaccactctggaatgagcgtcatggacagatctgaagggttgtcaattagtcgagatggaaatgatctggtaagtgtcccggatcaatacggttggagaactgcaagaagcgatgtgtgtattaaagaaggaatgacgtattgggaagtggaggtaattcgtggaggaaacaagaaattcgcagacggtgttaataataaggaaaatgctgatgattcagtagacgaagtacaaagtggcatatacgaaaaaatgcacaaacaagtgaatgacaccccgcatctacgatttggagtttgcagaagagaggccagtttagaggctcccgtagggtttgatgtgtacgggtatggtattagagacatttcgttagaatctatccacgaaggaaaattgaattgcgtcctagaaaatggttcgccattgaaagagggtgataaaatcggatttctactgagtcttcctagcattcatacacaaatcaaacaagctaaggagtttaccaaaagaagaatttttgcactgaactcccatatggatacgatgaatgaaccatggagagaagatgctgagaatgggccttcaaggaaaaaattaaaacaagagacaacgaacaaagaatttcaaagggcgctattagaagatattgaatataacgacgtcgtccgcgatcaaatcgccatcaggtataagaaccagttgttctttgaggcaacggactatgtaaagacaacgaaaccggaatattattcttctgataagagggaaaggcaagactattaccacttagaggattcatatcttgctatctttcaaaatggtaagtacctaggcaaagcatttgaaaacttaaagccgtttttaccaccgttcagtgagttacaatacaatgaaaagttctatcttggatattggcaacatggtgaagctcgtgatgagtccaatgataaaaacacaaccagtgccaaaaagaaaaagcagcaacaaaagaaaaagaagggattgatactcagaaacaaatatgtaaataataacaaactgggttactatccaacaatcagctgttttaacggtggaacagcgaggataattagtgaagaagataaattggagtacctcgatcaaatccgatcagcttactgtgttgacgggaattcaaaagttaacacactggatacattgtacaaagaacagatagctgaagacatagtatgggatataatcgatgagttggagcaaattgccctacagcaataaagcagcattcaaagaagaataattaaaacacactgaaagtgtgtttcttatatatggttatacattcatgaagatgagttcgtaatcggtatcttcttcaaattctgaaagtgtaaggacgtcaccacttcgtagctctatatatctcgctccaggaattacaacgttgttcaaacatgtcccattggacgaatccaaatccattacataacatttcaaaatgtcacgaacgttcctgaactggatgacgcagtgctgctttgaggatgtttcttcgggtataccaatgtctgcgacaacgatctccgttctatcgtcgagatctgtatccagactgtggcccagttcacgaccgactaaataacagctcctgccgttcaaatcgtatcttttccacggtcctttatccttgtcattctttctgtatatcactagttcatacatagtcctatctcgcgcctccagtcctagcatatccatgtagttatctggagaaatagcgtcctgcggctccacatgttttaaagctataccttctttgttattcgactccagctctaacagaccggaagggctgaagtctggcataatatcgatgtactgcgatttgaatttcttgtcatcatggccataatttctggtgttataaggtcttttgcgtctgtgaaacatgtctatacgcaaatggagtcggaaatgaagtacaccatgcttgctgtggcttttacgttataccaaggcttctactgtaggacgcctttattgtcaattatgtgaaaagaaagcaaaaaaaagaaaaagaaaaatgaaaaaagatgaacgtgtgaatgaaaaaaaactaattcgagatgagatgagattaaatgaacaggattaagaatacattttctgttgctaagagattaaaactaagcaaagttatgacgaactcagaattaccgagcatattcgaaggaactgttgatttagggattattggtggtacaggtttatataaccttgactgtctagagcccatcgctttgcttccacctatggtaacaccatggggtaccacatcgtctcctgtcacaatctctcagttcgtaggaactaacagccactttcacgttgcgttcatagccagacacggtattaaccacgaatacccacccactaaagtcccatttagagcaaacatggcggccttaaagaacttaaattgtaaagccgttctttcttttagtgccgtggggtctttacaaccccatataaagcctagagattttgtgttaccacagcaaataatcgacagaactaaaggcataagacattcttcatatttcaacgatgaaggcttggtaggtcacgttggtttcggacagccgttctctcaaaaattcgcagagtatatctatcaattcaagaacgagataacaaatcctgaatccgaagaaccgtgccatttgcactacgacaaggatatgaccgttgtgtgtatggaaggcccacaattctccacccgcgctgaatccaagatgtacagaatgtttggtggccatgttattaacatgagtgttattccagaagccaaattggcgcgtgagtgtgagctgccttaccagatgatttgtatgtctaccgattacgacgcatggagagatgaggcagaacctgttaccgtggaaaccgttattggtaatttgacgaataatgggcgcaatgcaaatattttagcttctaagatcattgtctcaatggccaaggaaatcccagagttcatgcatactggcgatgggctgcgcggatccatcaagaaatctatctctaccaaaccagaggctatgtccaaggaaaccttagaaagactaagatacttatttccaaactattggtaatggttgccgctaatcatatgtaaaatataaataggagagaaaacatatatagctatggaaagtattaaatgtttttttgctgtttttatattttcccccttggggactgtgagttcatcatatatgcatatttgctacttggaatgtagcccttcctagttacaggggtatgcggcgagttattgtcattgttagcactcactaatgtgctactgataccgctatgcctctgcagtgtgccaaatacattctttgtgtgtaaggattgagattgtagtttcgtctgttcctccgccatttccctttgtcttgctttcaaaggtgtctctaagcctttgaagagatatgctggatgatttttgaggtttgtttgaggaatatgtgttttgttctgtgccatttggctggtcttggaagtggatacgtagtgggggtgttgtggctgcaacccagtatcgacagatgattgcatgtctacccccaggagcttcttttgcctttcagtgagattcagatcacttactttgacggtggataggagcttccaaagagaaaacagtatattgagcgagactaataggtggaacaagtagtcaagaagttctgcattcaaccaactgaacgtggtgtgatatatgatgttggccttctttaccgtgtgaaatgtcaacatgtacagatggattctggatagccggttgcaaaactgtctcccaacatgagtgttgttccaaaagaacttgatgaacttcaccagcaggttccagaacgcaaacgcaattacgtttgtcataattctctgcgtctccatttccttgtttaccgttcgccgtgatagctccttgagcacaggactttcaaagttgcccaatttaaacattggtgtgtcattttgtgattgtgaagagggtttgctgtctgtgtccggcaatggtcccggcacgtcattatcgtccaagcccaattggcccgcctgaatcttcatagttccctctattatttttttgcctctgcggatatattaaaagtctgtatattgtcaagttcttataatataaatccttttgttcatcataaccatcttattaattgttattatttctatcattattactattagcacaaatttctttttttttttttttctatttttctttagactttagccctaattagacctgagaaaaattattaaaacctgagaaagttttataaaaagaacattataacctacaaaaaagatacttaaaccctgtagttaataggtttggaccctcttttcttttttttgcttttttttagaaaacctcagtattcacagtctaaggaacagataaagagaagctttatgaaagcagtccacagtgccacgaactttgacatatataattgacttgtgggggctaccgactggcttatatttctaaaatttagagatttgattatctttttcgcagcgcgtaaaagaaacccacgaagcatcgcttaatttacacatattcttcgttctccccttttggagaggatttaagctaagatatatctttcttcgagcgcagtgctgcttttgagttctttcgttttaattttccacttatttggcaataaaaactgagtgaagagtgcttctctgtctgttttagggagctttttcagatcatcatcagatgggatttatagcaaatatactgtgctgttcttcagatacttccaaaacacatcgtcaacgccaaccaccagaaactaatcacaaccgcaaccgcaaccgtaagcacagttcaaacaaagctcaaactcagggtcgtaagcagaaggctactccaaacggcgacaagatgcaatattccacaccgaagatccttttgtctagttccgattcaggcagcaatgcgggttccaagacaatgcaggagaatgggaatagcggcaatggaaaactagcacctttatcaagagatcactccaacaactcgtacgatgaggagaaagaatatgaagattataatgaaggagacgtagaaatgacggaggttaacaatgccggagaagaagaagaagaagacgacgaagcaaaagaaaagcaagaccatgtcgttcatgaatataacgttgacgcagatagaaattccagtattaatgacgaggcgccaccacaacagggtctgtatcaggtggatcaagaagatatgaatccacaatatgtcgccagcagtcctgataatgatttaaacttgatacccacaacggaggaggacttctctgacctgacgcatttgcaaccagaccagtaccatgcccctggatacgacactctgctaccacccaagttgcaagaatttaaacagaaaaaatgtctgatattggatctagacgaaactttggtacattcttcctttaaatatatgcattcagctgatttcgttttgcccgttgaaatcgatgatcaagttcacaatgtctatgttattaagaggccaggcgtcgatgagttcttgaacagggtgagtcaactatacgaagttgttgtgttcacggcaagtgtttcgaggtatgcaaacccccttttagatacgttggaccctaatggaaccatccatcatcgattattcagagaagcttgttataactacgaaggtaactacatcaagaacttatcgcagatcggaagaccattgtccgaaacaatcatcttagataattcgccggcctcttacatctttcatccgcaacatgctgttccgatatcttcttggttctctgatactcatgataatgagttactagatattatcccacttttggaggacctttcatcaggaaacgtgttggatgtggggagcgtgttggatgtgacgatatagatttctcagtaacataaaaagcaggctctttttattacccccccttcggttatatgtttggacgaactcatgtttctctttttatacagaagacttcaccggatatttataaacttaatgaattaatttgcttattacatgtatcaattgtactttacgtgtaacatctacagatacatatatccgtatatactagcatatatataaatatatactctatacatatatctatttattatgcttttctttcctctttttatggcatattatattttacaaagaaaccacaaagaaaaaacttttacctcaccttgcattaggaaacctcaaattttctatcattggtttaccaattctatctataacatcatgcgcccataaaacgtccagatgggaatactcatcaatataccagattttgtacactgcatttgcttcatgattaatgaagtgattaattagtcgttcaccatctactaatctatcttgctttggaataaacattataatgtgtggaaattcttcactattttgtcttttcggatttaagtgtagtttgttgttatccaaattattgccactgtcatcatcattcttggcaataggaaaccatgtctttttatctggaaaagttttttctgcgcccttcttaaaacttagcttattaggaagaggtgacaaccaccattgcattagtttgacggaaatatggactggtgaaaataagaaatttcggtcccttaaaaccctatcccataagacatcgttccaatcaaataggtagttaaacatgatgtatgagaggaacgaaaaaatcttggtcccaaccatcagttttctcattgtcatcataagaggtataaacgatcttctaccaaagtaccacggagaatcaataccttttgccattagccttacaaatgctttttcatccaataaaggtccagggtacacggcaggtgccaaagcaacaaagttttccagcttatcgactaatttaaaatcacttgcgtatagtttctcgccgttgacaagccccataaacccttgtgttgtaccttgtgaatgcgccacgagcgatagtttagcatatccggtactatcaagtacataatttataagtgcttttaaatcgtattgaaccatctggtgcatatcccaatcccattttttggaatgatcattacctaattttttcatgttccacttggcatttaagccacatctgttattccccaaccaaacatcaaatccagattcataaaggaagtatgccagagattttctacctgaagatgcgaaggccccgcaactttgcaaaagaccgtgtaatagcaaaatgggttcacgtttcacttcctctacgccatcgtttaacctggacttgaagtgccacaaatcaatgataaaaccgtcgtctgtctccacctcaaattcttcaatatcaataccatactctttataatagtactttaagtcaggtaccagcttggtatcctccgcaagcgcaatgttttggaagggattctctgcagcatatggggcttggttcacattcgtttccattttaatattagcatttccatcaccgttctctgataaagaggcattactagtcatggacagcttgctagtcacagtacggtcatattcaatattattctcctgatcccgctgtaaatctaagggcgttgtggaagatattgacaaaggtctagagtgacgtgctggtcgtttcttcttcttgtcatttggctggatcttggttctcgaacttcttgtatctcttggatcatttttatgttggaaatgaactgtcacgtaattcttccataatgacaaaatgaataaccccgtcataaacgaagtgagaattattgcgctcaccaaccgctgaacctcatcaaccaccttatttaccatgcttatcgtaaaggtgccacggggatcccaatgatagttgagtatttcccaacaattttaattatacctttgatgagaaacatttgcgtactatttgtgtgaaaaaaaatgaagaacttaatgcgcgaattattgggataacaacgccaatggtgaatcaaaatattaacaatgacaaaaagaatgggctatttttgtacaaaatactgttgcaaatatgatatcatatgaattccaaactcatctaccgaaaggaaaagataactcattgaacgcttcatccgaaaacaaagaattgtatgtacaagccacgcactttaataacacaattctattgcagatcagactaaatggggaaatggattccacctatgaggtatcttcaaaaggactaaacccaattctcgatatcaacgtaccactggcaggaaacctaggaaacacgggtggcgattatgacgatgaggaagaagaatttgtaagagaccatttatctgattatcaagtggttaccaagttgggagatagtgccgatcctaaagtacccgtggtatgcgtacagattgccgaactatataggagagttattctaccagaagtgagcggtacgatggcccaagacaacatgcaattcagcttgctgatatccatgagcagtaagatatggagagcaacgaaggaacaaagcgctgacgataatgattttggcaaattagtttttgtgttaaagtgtatcaaagatatgtatgcaaagtgattctatataaattagttatgcgttgtattatctatgactgccatatccaagacttgcacagttccctttttatcacatagggtcatcaaatctctataattgacaggatcgataagacctgtacatgtccaaggatccaattccggcttcgttgactctccaggcgatgaagctatcaatttactaatcttctcaataagttcgggttgtctagatggctcacttatggccactttgactttcatcttcgcccttactattggaataatttgcttagaaaccaataatttgatagcctctaaagcttgcaatttggcaggtttgttaataacagggctgaacttcagttcctgtaaagctttgtggatcattgtgggcggatatcttttctttgacacaggatttatacatttagcgctaactatggtaagcatttcgttattaactttattaagcattaattgtctttctttttccgataactgaatctctcccttatgcatgatctcctcgatgacatcatcaacatttgtagtcccgaaacacttttgtagatcttccttattagcaaccaagcctttcgaaacattcatgaaaacttgatgtatctgcagcacttcatccagatctttttcaattccttttcgatagtcttggaccttattttggtagcacgcgacttcaaatctcttgcgagccttttttaatctcactaatgaaacattagttaacttaatctgtcccgacggttgattgataggcattgcgtgttttaccttttctttctcagaactattttagtaaaaattttaaaaacttttactactgcatgaaatcacttaagttcggcctagaaaaattttttcatgaacattattatatatacaaggcactgagcagaacaatacacgctaagttttgttctttcatgaggtcataataagttaaataacagtcaatacataaatgcaaaactaaaagtacacagttttattattttcttttcgtcgtaatgtagtttttataatcagtcaactttttttttgcttttagatttcgtttgttccttttgtctttggatccaaagtttcttgaaaatgtagccaaaacaatgccagcaggaatatcgaaaaagatgggtataatataagtaaaaaaaaaaattttaacaatgaaataatacaggagaattcgtggtttacaatttctggtttttttcgaaattgctatgtggcttctccaacaatgtaattgtaggcttttctttcttttaagtccgtttatcgtatacagaaaaagtgcaggatgttgtaagtaaaggtagtcagtcataccatcatgacaaaatccacctcttggcaaacatatctaaaatagctctataatggccgatgacacccaacactacgaagaaatgccaaaaagtgtgcgaacaaccaaaatagtcaacccaccatagagatttaaatgatttggcatgagacggacaggaactgcatttggaatgggctgttggcacctctctaaaatgaatttccctttgctttgtgatgatttctaaatcagtagataattcgtagtttgttggaatggtcttatcaacctgaacgtcagatctgaaccgttcaggaatgaacgaaccgtaaaataccacaccaaccaaataccaaacaacagatttgtatgtgacggggctaaatagcgttgcagcataatgaagatcagtcaaaaatatcaaatgtaaaaacgacaatacacccatagtagccaacaaaatgaagaatctaattcttaatggccttgcttcaggtctatcaaagtgaggcgaccaattcataaacacaccaaatacacccagcgccagagaaatacccatgtaagtgcacatcgcccagtaacatgaatacatggtaacaaactcagttgtcaatatcgaagctgtaattaagatcgtaataccgctatagtcgacacacgcaaatttagaacgtagcttcaagaaggacgttccgttgaaagtatgccaaaacacggagcttagcatacatttcaacgcagctgccaaaaacatgaaaacaatccatctagcctgtggtggaacctgggaattccgccaaacttcagactgagggaaatcgtaaattgccaagtagattatataaatggctcctaacaaatgagaccaaatatttgaagtttcattatgccagccgtaccagttaaaaatagacagcaaagatttggaatgggtattgtaaaacctatagccatggattatgtatctgttttccctccatggaaatggcaactgataataatgtaaatgttgagtttcacctagactatacgctttgccatggttgtatgagtttataaaagacttgatatcggtagtaggattcaaaggttcttcaatgaggatttccgtctttaccatggattttctcattggaccgcaatagtctttcacgctggaaatataattgttttcctctttgatttttgtatcattgagacgacttgttggggaacgtaacgaggacttcgcttgagaacatacagttgaagatgaagacaccagtgaagtggatgtagaagcattattaagcttgaaagtagcgactgaattcaccaaagtggctgcatctgaatctcccagtgaaaactgagattctgtattcagagacttgccactgtttcttttgtacacagaacttgttccttccttttcttttgttggacgaattatctccaaatcatcatatcgcccactttcagagtgtttaacactttcatcaatagttgaaaatggatgaggaacgaattttgagtagttgtaattatagatggatttaccggattttttcaccttctgaaaattgtccacacccttctgctttagccttgatagagatcccatgggtgagggtatatactgagttaagcttttgcttgacgagtccatcatgtacttaattgattgtctgttgggatgtgaactatttttcagcttatctgcgttgcagcttcttctttgtccactttacaatggctaaactttaccagacgacaaaacaagtgtagaatttgaatcaactgtgtcctaaagaaaaaataatgtccaaaaactcttattataaaacgagtaaaccaccacttcgctcgaatcgccaagctttctagatgtacacccacgctgtgtcaccttatgactatataccttatccatcaacactttctccatttcctgcagggtaaaaagaaaagtgaagtcaccctgcactatacgagcttcagcccataccccacactaaaacatttctttttctgcggcatttcttttttttttcggtccgtccctgtcccttcccacgagaaagcgtaatgatcctcgaccctaccccacttccccatgccaattaaaacagataaaatttcttttgattttcggatacgctaatttcgtagcaattttgaatgactagacatttgttggataactacatagtctcccacccaccaagatctgcattgccgtccgttagtcggaacactatgtgcggaatcatgttgccaaaaacaatctcattcgctagattcgcgtatctcgcccgattcaaatagacgggagtaccgaatttgtagtcttcgttggtctctccgtatttacttagataaggtgcagcataaaatgtacctcttttgccgtatgacagatatatcgcatttgtgccggtcattaagaaaactccgtaagcggaggtgatttcgcatccatttctcatatgatcagtacattccccctgtaaataaccttgcagtgctatgcttttttgaatatggcatttttggccacacaacaagcatactgcgatttcgtatttatcacatttattcgatatttcatcattatcaagggaaaatttggaaaggttcaatggtagttcgataagctggatatgctctggtgaaggatatgctcttgtgtttatgttctgcaccatgtcatatattacttgctgaattctcaaattatcattaccatcattatacctttctatattttgtgttagttcgttgtagaaaaaatccttcaaaaagtgagttaaattgggtaatttaaaataccggaaaataagctctatttcacgctgtttgacgtccatgaaattattgctgcggttattattattatcatcatcaccatcatcatcatactgaatgttgaataataagaaggttcttctacaaaaaatggacaatgactctagtaatagagagcatataaagtctttaattttctctaaacttgtaaaatcaaaccgaacgtcgtctggtttaaagagatcaacatactttttaaaagtattgaatagatatgaaaagcttgtcgatggttcctcagatccgtttgatgatattttgattttatttcgacagtctttgtaaaagtttactctcatcatatctcttgcaagcaacagtagtagttgatggaaccttcttttgaacatttcatagatacataggttaggcggttgcggggtttttcctccatcaatattatcaaaattttgactcatatacaaaagtagattcacattattaccctttattagaaactcattccaattccatattttacgagagatttcgctgctgaatgtttttgaatttaccaattttttataaataaacgactttagctcacaaactaaatgtaaggttaaaatgcactgactggatattctttccatattcactatttttccttcctttttgtgcgatcttaatctgagctcagtatttgaaatagtattaataaaaacactattaacaactttatatgcatcttcgatagtcgtgacttttttaccctgaagatcacctagaatcatcgctgctttaatacaaatagagctcattgggtcaaggttttcttccgcttcacttcgcttttcaatacacataaaaaactggctcgaagttctcttatctatatcatttgtttttggtagaaatgaattacttaaggaattgcatacgggacaatatatcaaccctgaaccatacgataatggaatattttttgtagtttggttttgtattccgcgaatcgacttcatatggccacttaaacatttggtatgagacccatgcccgcatgctcttaatactggttcacagctagtaaatttcaatctcgttccatcatcatcctgggtgttttcttggattgcactgtcttttgtttgcttaccactgaacagctaatttattctattaacatctgtaggattcgtaaaatcaattccatgatcacatatgttccgttcttggtatgaaaaataaacaaatacatcgtcatccttcggcatcttgcaaaatacgcaatcatcatcgcagcaactgttgattgtgttactactattctctgcatctattctagtgggagataaactaggtgatgtggttctgggtgtactaatatcggaagtatctacactattgttttccatgaatttcatttgctgttgagccaacttcttcattaattttttttttctcaatcgagcaagatgttttttcctttcaaattctttatccttgtggcttttatcttcctttgtaggccacaatattcctggtgtgtatgacgtggtttgctccctcaaataactgtttacatttacgtgaggcgctgtttccattaaatacctgaaaatttccctaatcttaccatgagattccgaaaaattatccttcaacaaacagtaatacaggatagaaccaatgctgtggtaatgacagaattctgtgtccacaattgcgtattcatgccacagtatccccataaattcattcagattattaaccacgcataaatgaatcaaatgaaccactctcggcaataaattgtcataatcatattttataatgtgatctaaagtatttttcaaaaataaaccaaaagtattcactgatgatattgaatacaacccagaaaataatgtatttttcaacaaatctttaaccttttttgctggtacaaaagtatcttcatatttcattttcttcaaatttgccatattcagcctgatatttttctctacatcataccttctactggaagacaaccctatataataaggatcaatctcatctttatacttttctttcaacacgaaaacgccattgtcagtcaagcttacaggagaagtgtaattggcgtatttttcgagatatatatcaaatgaagggtgcttggtgatatgttctggaatacagttaacaatttgtgcgtaagagcatgtatcaaagcaaagggcatgaattatttctgatttgaacgttctctcaaagccttcctttgatgatttcatgaccaatgatctcacttcagtaagcaattgaatcaataacagaatgcattcattaacaacggctacagttgtttctgtatcaggataatcatacataggtacaccatttgcccagtgcttcaaaccccaccttgagaggtaagtaaccatcagttcatcaggattgcacattgccatactaaattgcacattgaaaatgtcactaatataagtaaattctcgcatactgtattttgtatacatccgggcctggtgagtaattggagttccgtttcttacccagaaaccgacgtttatttgcccgattaggactagggttgacaaagcagattctgatatatataaagccttctgcttatcttgaaaaacttcgaagagattaatgtagtttgtcaaagaagcaggcattggctcatatctaccacattgactccattgaataacaaatttgaacaaatatgacattggattgaaaaaatactgtgtatttacacctacctggaaattaatagtctctgcgacataattgcatatcgtctctctgactgtagacaaagtcgctttgttcgaatcattttcattcgttgatgcgttatcaggtgatatagcttttctagaattggttagtgattcaaattccctggtttgagcaacatcaagtagtttaaggacgatttgcttacggaaagccgcatctttgaccaaagatatactacgtgtgtatccatctgtcattattagtattgatgagaaaaaaaaataaaatgcagaaaaatcaaagttttcaacctccacgtgttctttagtttcccttttcaatggcagcacgttactgaattcagagaaggactcaattattgcgttaaaaattgcctcatttgaaagtagttcttccggaacagtgttcgctgacattatcgtacaaaggtctttaaagcaaataattgtccttcgatttcgtattgtttcggtgggcaacttaaagccattgtataaagagatgggcaaatatgacatcaagtcttctggattgaatgccatgagagtaaaagcaaatctaatagttcgttcaatgaatcccgaacttatagtcatatttgctatgctggggtcttggaaagtgtattgccctaatatactcataagagttacctgacattctttagcatctgatgcaactgtatcatacaagaccgatagataaacatcaatatattgtgcggcaagaaactttctgctttcatcccttaacgagaataatgacgccatgatctttaacattttgaatttagatttttttgagaggatattaatagaattgatgataatatattggaatctagatccatagaaattgtagaaatggcttactgtgttcggcgaatgggctctgatcaacctttcattgtaattagtgagtatttttgaaattctttcgtcttcaatgttctctaatgaccaaggtttaaaccatgattcatcactatcttcgttagatattaagaatccacctaataagttaatcttagaaaagtcaggattggtatttgtgggagatactctcattttagaaaaatgggaataccaaacatctagcatggaaattctaagagcatatttattttgcaaagacgtggccgccttaaagcacagagaatataaccaatctgttaaatcatctgttaactttctcttgaatatatcatccgcttttcttacatgaactactatgttttccttttgaaactccttggctatttgatctatttcgaaaaaattctcactttgtagcacagtcactacatcgtgtgaatcttctaaagccttcgttattgagattgcatattcaaccggtgtattcaaaattcttgttattgtagatgctaaatccatgtagtgtacgttacactcttcttcttcgatttgaatagcccactccatatgtgcttcttttctcgtattggaccaattgttatcaaagaaaacaaaattttcatcattgaccaatggttcacattcgtgtttttccattatatcatcagtaatgctgttttgattaggatgcattagggaggatgcttttctctcgcttgaatgggcttctgcctcctctttgtatgaaacagttacatcaattaaaaaatccagaacataattcaatagggagattacgttttcatcatcggttacgttactattgtcgttagaaataggaatattatttaattcgttcttgcacttgaacgcgtcgcttgggtcattaaaggcaaaggggtcaccacaatggcatattctgccttctgggcgcattaccactttagcaacataagaatgatttacatgtttttctttatcgaaacaaagctcacatatttcatacaatggatttgtggagcacgtaaaacagtaataaattgtctcagaggggaagcataaacgcgtacacgctgttccaatatgcatattacccacagagtggtggtcattctcgaactccagggtcctccactttcttccatttagtatgtctctgtacttttcgttttcccaggcttcagaattgagtattgaaacgagagagcgccagtttatatcgttatcactatgcttaaggcgtagatttaaggttttccatagtaaataactagtggtttcgctatattcgcatttcgcgagtttggggagctcggtaagaaaatctcttatattggttatagacaggtcagaatcttccatgcgtgcttgttaagtagctattaatttagttaacgaatcttacctttactatcagagacgagtaaatgataataattagaaaaaaaagccggctctttttttaaaaaagcttgagcaacttttttttttatagagttgttagtaatatgccaagcaattgaaagtatgaatgcgttgattattgggtttctccccacagctgtacattgacgatgctctttattgatatcgcctaaaagttcaacaaacgccactggaaattgccgccgttgtcaccacaacgtgataagtgatggtgtgctttttgcacatctagtgaagaaacgggcaattaggatctaggaccagtaacacttgccccgcaaatattataacatgggccttatgattgctcggtttgttacatctaacatcctaagaagtgagtggcatgaatacgtagctatatgtagattgaaaattgatgagtcgagtcatcaccttcctctaaacgggggataaattttggcggtattttccctaattttattcttcgttatgtcagccatgtgagactaattaattcaagttttgacttacaattgcggcttcgtcggaaatcagtattacgtataaactgtgtaccataaaattggcgtactcggtattgtttatactaagccggccattctagtgatttcgcctctataaatggttgttattcgagtataatatttcaaccgcatcaaagaaagaggtagatagcttgcgttcaacaccgttcttttctttcccccttaatttagcgcttggcggttatgctatggtgacagttaacttttttaattataggatgacttgtcatattgttatatgccgcatacttatgtaaagtagttattgaggtgggggtgagcagagtaacgacaacgatggagttccgtaactaaccaatgcttaatgttggtaagtaatagcaaatatatatactacatagcttttgttatatgcatcactttatacgattcatgttcgacccttttgataaaagatgggatttttaaataagtcggtgggtgatttcgaatcatgaatagttggcagagcaggggaagtacgagcttctaaagggtaagatattgtatctcggacggaagcagcagaaacataacagtattgataaataaggcatgtggtcatcactttttggttggacatcaagtaatgccaagaataaagagtcaccaacaaaggccatagtgcggttgagggagcatatcaaccttctatccaaaaagcaatcgcatttacgtactcaaattacaaatcaagagaatgaagctagaatctttttgacgaagggcaataaagtaatggcgaagaatgcacttaaaaagaagaagacaatcgaacaacttttaagtaaggtagaaggcacaatggagtctatggaacagcagctattctctatagaaagtgcaaacttaaatctagagacaatgagggctatgcaggaaggtgctaaggcaatgaaaactattcacagtggccttgacatagataaagtggatgaaactatggacgagataagggagcaagtcgaattaggagatgaaataagcgacgctatatccaggcctttaattactggggcaaacgaggtggatgaagatgagctggacgaggaattggacatgctggctcaagaaaatgctaaccaagaaacgtccaagatcgttaataataatgttaatgcggcgcctatctcagagaacaaagtctcactacctagtgttccaagtaataaaattaaacaaagtgagaactctgtgaaggacggggaagaggaagaggatgaagaagatgaagatgaaaaagcattaagagaactacaagcagaaatggggctttgaacgtgttctatgcggtttagatgaaagaaaaaaaaaggtgttcttactttccatgttctgtatacgctcttttatatacatgaagttcataatgctaagtcataattaatagtttttatttttttgttgtcttttttttgtcgttcataggtatagaagggaatgtgcattcattatttttatctgttattgctatattattgtacagaaaagatgagagaaggaaaaaaaataaataatcaaatatgtatctttttttcttttactttgcttttaattgactaaaacccaaataacgaaaaatacaaagattataaaaaaaacctttgcggctaaccatctattactttttatcctgtcgaagtatttcaaaagttccctttgagcaccactaatgtttaaatcgatgtcgtctacgtttgcatcaatcctttggattacttcgccctgttcttgaaccatggaggccagttgttggaagagatttcccacttcctggattgtggattctattgtctccaccgccctatttctttcttgtaagtagacgttattggataactgtccctcttccattaacattagttgagagtcgttttgagggaaagacagttctccttggttggacgagttgttattcttttctgaggattcatctagtagtgaggtcatgaatgggttggagttgttatacgtggtcaagtccgcggcgtgattgctttgcgtttggtcatcagctggtgcatgtccagtgtcggtggttagtttttgccatctgtctttgttagccatttctagtcgttgcctttcctccaatacgtctttaaaacttcctgatatgtttttcatttgcgtgtttaaaagatttacgacatttttggagtgctgtacggcactaggttgcttagaagattgatttgatgtgttgccattcacgtcggttttcttgagctgacttaattgcactaaactttgttcgatggcataaatcttccttttgatcaaaaatgatagctcggcaatctctacagggttgtcattgaacatcggtttccttttggccagcactgctaatttcgataataattgtgcggtggatgaaatttcgtgagctatgccagaagcctttttttgaaactcagagacacttttcccattgccggttgtgttgttggcaaagttttcactttctttctcttgtagacgttccctctgctgttctctaaagtttttgtttcttttcttgtaactcaacacactttgttgaaattctgaagttctatcctttatgttcatgggagttgtgtggtatggtgaaatggtcgttggaaacagaggcggaataaaatatatacagtaaagagtgggtgatttccgttcaaaggtctaacaggagcgtcgatgcggcggtaggattttttttttttcaatttctatattgacattattatcataatgattgtttcgaatatgccctttcgcctcgcctcgatcaataaacctacccggatattacaacaacataataatacacctgtgaaggtaaagaaagagcatttctcttttttttattttttttttttactttctttacattaaaaaaaatatgaagagtgtaataggtaagtataagtattatttaatcattacaatttagcttcagtagcatagaagcgcaccacttcatcaatggctttagccacgtattccacgtttccttgattcaatccagcaatagaagctctacctgaggcaaccaagtaaactgcgtgggtttcttcaagtcgtttaaccatttgaggagtcaatcctgtaaaggagaacatcccgcattgatttactatatgatcccagttgccaggagtgcccaacttgactaaatggtctcttaatgcgtgcctcattttcgtaattctggaggacatggtaaccatatccttgtgccactgttccgttaattctggcgtttccaacagtttagcgacaatcttagcgccgtaggccggtgggttggacacttcactacgaatgattttggccaattgagatgtaacagcaggctttatagttttgttttgagcttgttttgtaagtgctagatggaaacaacctacacgctcaccgtacataccggcgttcttggcaaaggactgacagacaaagacgggagagaccgttgaaagcttctccacacctagacgcacagcataggcatccttgtccaaatctccagtggcaaacccttggtaggcggtgtcaaataaggcgatgtggttttttgaggcgatagcatcaacgatttgaacccattgttcactagtagggtccagaccagttgggttatgggcgcaagagtgcagaacgaaaatggagccctctggagctttttgaatagcatttagaaagccgtttaggtccaaagacttagtttcgttggcccagtaagggtaagtcgccgttttcaagccttgattctcaaaaatggccatgtggttggcccaagtaggcttagacaaatagaccagtttatctgggaagaattttgaaaaaaacttcgcagatatatgaagagcacccgtaccagacagtgattgtactgagattactctgtcttcctgaaaggcatcggattgcgtaccgaagatgatcttggcggcgttagatgtcaaacttggcagaccggtaataccgaggtattcatggttgtaggagctgtcgttatgaattagcttttcggcggctttaacacttggcaagacccatggtttaccgttgtcgtctctgtaggccccgatacccaagtcgaccttggtagcacgttgatcttgcccgtacctttgcttaataccaaaaagggcatcagggggcagcaattcgatgttattgaacagagtggcagacattatcgctcttgtgttcttgtattcctgtgttcttttgttcattagaatttggacggttgcgctttcccttcttaaagtattcacatacgtttatataccgacgtgcaaggcgacaaggtaaatgaggccgatcacgctgactcactcggtccgactctcggcgatcgttattcacgaagacgaaagatagccatttccagtggtgaccattagtattgacaatatgtacatcgcattaaacagtaagaaaacattaatattccgtcaggaattcctgtaaattgctcttactacaaacctgcaatgcccatatcatcatattcaaagtaaaaatttcattttccgtaattattcttatctttgggtgctttgtggcagctactggagtaattgtgtataatagatgccactagtgcagttaaatgaaatatcctacattgagagtttaaaaaattgcctccttgtatgtttcttgtaaataatgattttatgtccttctagcgtagtaaccctaaaccatcagcggctattattaacattgttaccctgaccatgcttttttatttcaagaaaaattttcctttagattctctcgcctatataaacactttgaaactctcatcgtcgtgcatttaacttctatggtaaacttcttttcccattcaagtttctctttgcttatttgtaaaaaaaaaagtaaccatagtctcgtgctagttcggtactatacagggaagggaagtcactcgcatacgtgtgtgtgcatttcttgctattgctgcttagcttctctaaaacactgggctagcgtttttcaacgctcgagaggcagagtctcaaggagcctccaatgggcctcacgtattcatctagatggcgcttcggacaacggcatcacataagagatgcagctcctgacttctcctctgatcttcgtgatcagagttttgagtcgtcggactacgagcagtttctcttagtcgttgcatcgggtgctgttgccttaacgatgtgtatatggggttcgggggctgttgccatgatatatatggatgagacagaagtggccccgttgacgagtttaacttagattaagtaggacgcatgatcttgagctcttttcctatactttgtcctatggccagctttctccttattacgaagagattgcgggatgtgggtgcagagtgggaaaatctgagttcggtcatctttgttgttcgtcctaccgcagtatattcctaaacactatgaaatgaccctagttggtccatgatcatttgggtaaaaccatactgcagacatctctataattcacatattcacatcttgtcctctcacagaagaggaaggtctttgacgtagaaaattaagtaaatcgtatacgtttacgtatatacacttgtattcagctatatatgttgtttctgttcttctcataagatgtaccctactcagtggtggaataaacgaattgggttctccacgtagacgatatcaaatgaatccgccgcttggaagacaactttgtccatgacagaccccgaaggagccgtgatgaactttacaccagactgcacagctctataaacgttgtctgggaagggaaagaacgcatcggatgataacgatacattgtttaatttgcttaaccattctagtctttcttctttggtgaaaggttcagggacttcttcaaatttgctttcgtaatccaccttttccgggccttctattctttgccctgtaacaaaaagatcaatcgcattcgacttgtccgctctcttaattcccttggcccacttcatgttcaaaacctttggatgttgtctcaaccaccagttgtccgtcttgtcaccagctaatctggtacagtgtatacgcgattgttggccggccccaagccccacaaccataccattctttgcgtagcaaacagaatttgattgtgtgtattttaaaaccagcgtagcaacagttagatcgataacggcttgctcggtaagtgctttgtttttggagacaatttctttgaaagtggattggtttatgatcgcatcgtttctcttttgttgtaacgttacgccaaaaacctctcgggattccatttggccaggaacatagtttggatcgatttgtaaaatacagtattttccgtttttcttcttagatagtatattcaatgcctctggttcataccctggagcaataacaccatcggaaacttctttagagatgatttttgcagtggcgacatctacaatgttggacaatgcaatgaaatcaccaaaggatgacatcctatctgcaccacgggccctagcgtatgcgcatgccaatggtgataaatcctccatatcattcacaaaataaacttgtttttccacctcggataatggaagtcccacagcagcacctgctggagaaacgtgcttgaacgatgctgccgcaggcaagttcaatgatgcagataactctttcactaagggccatgagttcaaggcatccaaaagatttatatatcctggtgtaccgcagagcactttgaagggcaactcctcctgctgagtgatataagcttgtgcaggtctttggtggggattacaaccatatcttagcggtaattgggctttcccttcggagtactgtttcctgaaaaagtcagaaatggccgcatcataatcggccgtatgttcaaacgccttaagtgcaaatctatttcttaaatcctgagaaatttcaccgtccttagacaggtcttgcagaaagatagaatagtcattagggtctgaaagaatagtcactctggaatggttctttgcggctgctcttaacaaagtcacaccgccaatgtcgatctcctctacagcttcttgaactgtaacaccaattttagccacagtttctttgaacggatatagattacatacaacaaaatccaccttatcaatgtgctgctcttttaaatctttttcatcgccctctaaatttctggcaagaatacctgcatgcacagcagggtgaagagtcttgactctaccccctagcatttctggtgcatgcgtaattgaagaaacatcgtcgaccggaaaaccagcttctctgaccatgttggccgtaccaccggatgctaggatacgaacattgttctctaccaatcccttggctaagtctaataaacctgtcttatcataaactgacaggatcgcagtcttggtatatttgcccatttttagctcttttgttttttgtccctatttatggtatagttggattctttgtttggaatggggtattgattagatcttgaatgttatctaatcgctaaaaagagcaagaaaaaaacacaaatgctgaaaactggaaaaaaggacgatctatttgccaattattaaggcttattcttaaagtggaaatagccctctcttttgcttttcttgagttttatctaatggctctaataaggaaaaacgggaagaaaaggaaagaaaaaaaatacaagaaaataaggtgcgactaaaaagaacatggtgttaatttatgcggcggagaaatttacttgagcatagagagattatatataagtattatggtagtgccaccacctatgtaagctgctagcattggtatacgtagaacaactaggactccctcgtccgctccttgatacaggtagataagttctgcctgaggggaggattgagaagagggggtaggggtttgcttgatagcagaataaaagtacagctctaggtctataaaaaaaaattggttaaagaaaaaatatacagttttgtatatagaatcattaattaaaaagataatagtataaaacacatcagataaacaaaagtttgcccaataaaattatattttccatcaaccagcttattttctgtatctccacaaggacaaagtgttttgtctcttccaggtctttcttctaccagccttggtgttgttgaatttgtgacccttgttgatacctctggatttcttaccagtagcagtcaaacctctagcttcacggtgcttgtgaactgggttacagatccagttgtaacgagcatctcttctgatagccttgtgttgagggtcgaccaagataacttcgaagtacttgtaagtagaatcttggttaacccagtaggagttcaagactctcaagttagcagcacgacgaccaactctttcttcagcggtagctctcaaggatctttggtatttcaattcattgacaccttggttagttggcttaccgtaagtagcaccctttggaacaggtctctttctgttaccacgtctaactctgacacggtagataacgaaaccttgcttagctttgtaacccaatcttctagccttgtctggtctagttggtctagcggctctgtgaatgacattcttttgtctgtattcccagactctgactctttgcaagaatctcaaaacatcagattgcttctttctttgcaattcttccaaatatttgtaggcacccattgctgatttatttgtttgatcgtggttttcttagactgtaaaagaattacttaaggatagagaaagaaacgtgagaaatagcagttaaatgtaccggtggtaaaaatgcaatgccatcattctttgttaccaagcaaaagtgagaaatcttgaaaaattttagcacctttgaaaattttgcgtcggctccaagaaatttcagaaaatatattcgacagctttaaatccgtacatttatcaaaaaaataacatcatgtttgacgatgtatgctatgtgaatcatgtcataatatgcatcagttgatactacaaatgcatctcggatagagacattgtcatgataatcgcaacacatgtcgcacctgatgcatgttttgaacttaacactaaatatctaaacgttatgtagggtgcgagtccatctcattcttgcccaataaattttagaaacaccctcttatgaagggcggcaaaacatattaagtaagtgtcgattgttgaacacttcccctttttttatgcatagtaaaaggtacaaagaaaatagcgtaccgtccctaaatcaatatagaaatataatgaaaaaataagtgctttgataagaacatcttgaatacaaattaagaagtgtatatttatagatattttcgtttcagcttgtgtctgtgtgtggccttatatgtaatatatgagatggaaggtgaacaaattatggagtatgttcaagagacaccgatcattccaaaaaggattatccattattcgattccaaaacaaatgatcacaaagcccgctccccatgtcgagatgacgttggtagctaatacttttcgggacatggacttgccgcagcatccggttatccatgattgttggcaaaataaagaatactcaactcaaagatattcaggaaatgcggctcaacagagattaagttttgaggaacatccaaatgaagagtgtcaaaattctgttgggttaatcaagagagtgagtactttctttaaaaagaggccattgtctcgaaagaatagcataaagtcaatcggtgacgtaaaatcggaggcacgtaaccggggagaagggctcctgggtgaagttgataatcttaacgagcagaatgtccgagaaaacctgactagtgaacatgaaaagaatcctgaaggagattccaaaaggtatggcctgttctcctttgaagggaccccccctatacaagtgttggagcagggcaataccaattctgagctttcttcatttaaaaacacttctttggcggaaaacaaacgctcttctgacagcttcgtttcgttaaagccgggtgaagatgaacatagccctttagagattagtacgtgtggtaatttgactgaaagagaggatttgcaatctggcgaagaacggtttgactcagcagcccaaaatataaaggtagcttcgatgaaggaaaaaaaaaaattcttcaaagggaacaaaacagattaatcactgagattatacgcctcgaaaacatactaaataagcataggaaggctgaagctaagaataatattaacaaacttgaaaagaagttgagtgaaacagatggttttacatctgtaaacacatcagttccagtaactcctattatgccggtcttaaatacgagaacttcttatcccaatatcgactttcatggtactaaggtttctgatgttctagatgcctttgaatttgaaaagcatgatgatcccttaagggataaatggaacactttacagtttttggaaaagagctttgaatctaaatttgaatctgcatcagagttaatccaaggaggcgagctagctgctattaaagaaagaaattttcaattagccaaactaaataatctttgctttcgggtacgagagtccatcaaaagaagacaagacctggagaaaaagttgagaactttatcacaggacactgacaacgaactgctttttctgatgttggagaatgagagaagaaagaaaagttcagtgataatagagtttctttctgagataatcagagagaaatccaaaagattaactgcagaagagcaaggctttgtaaatcaaaatgaagtaaaacccctcattctggacctttctgcacggataaatagattgaattctattctagaaacaaaaaatacttgtattagaagattaagtaatcaataagtagttaaatttcataaattataactttcttacatgttggttggcgcgtcgtctggctgaaaattttacgcgtcataaacccttaacttttccacacattattccttactgctaagcgcactgctcacttgaaagtaaattatctacaaagttacattatcaaaaggccttagaaacacacctaaagtcttacagtatcacaatatgagtcatattgaacaggaagaaaggaagaggttttttaacgatgaccttgacacttcagaaacatcattaaacttcaaatctgagaataaagaatcgtttttatttgcaaatagtcataatgatgatgatgttgttgttgtatcagtgagtgatacaacagaaggagagggagaccgatctattttgccagttaggcgagaaatagaagaagaaggccagaatcagtttattacagagcttttaaggattattccagaaatgccaaaggaccttgtgatggaacttaatgaaaaattcggcagtcaggaggaagggctctctttagcattatcacattactttgatcacaatagcgggacgtctaccagcaagataccgtcttccccgaatcagctaaatacactctcagatacctcaaattcaaccttgtccccatcttcattccatcctaaaagaagaagaaaatacgggttcagaaaccaaacacgattagaagataaagttacttggaaaagatttataggtgctttgcaagtcactggtatggctaccagacccaccgtcaggcccttgaagtacggctctcagatgaagctaaagagatcaagtgaagagatttctgctactaaagtatatgactcacgtggtagaaagaaagcgtccatggctagtttggtaagaatttttgatatccaatatgatagagaaattggcagagtttcggaagacattgctcaaatactataccctcttttaagttcacacgaaataagttttgaagttacattgattttttgtgataataaacggttgagtataggtgatagctttattctacaattggattgctttttaacatctctcatttttgaggaacgtaatgatggagaatccttgatgaaaagaagatgtacagagggaggaaataaaagagagaaagacaatggaaattttggaagaacattgactgaaactgatgaagagctagaaagccgctcgaaaagactggctctactaaagttatttgataaattgaggctaaagcctattttggacgagcagaaggcattagaaaagcatgaaatagagcttaatagtgaccccgaaatcattgatttagataacgacgagatttgctctaatcaagcgactgaagcccataacaatctccgagatactcagcacgaagaagaaacaatgaacttgaatcaattgaaaacattttataaggccgcacaatcatcagaatctttaaaaagtttgcctgaaacagaaccttctcgcgatgtcttcaagctagaactaagaaattatcaaaagcaaggtcttacttggatgctaaggagggagcaagagtttgctaaagcagcctctgatggtgaggcttcagaaacgggtgctaatatgataaacccattatggaagcagttcaaatggccaaatgatatgtcgtgggcagctcaaaatatgcagcaggaccatgtaaacgttgaagatggcatattcttttatgcgaacttacattctggtgaattttcgctagcaaaacctatattaaaaactatgataaagggtggcatattatcagatgaaatggggttgggtaaaacagtggcagcgtattctttagttttatcttgtcctcacgatagtgatgttgttgacaagaaactgtttgatattgggaacacagcagtctcagataatcttccaagcacttggcaagataataagaaaccatatgcttcaaaaacaacgctaatcgtggtcccaatgtctttgttaacacagtggagtaacgagtttacaaaagctaataattcccctgatatgtatcatgaggtgtattatggtgggaatgtttccagtttgaaaaccctattaaccaagacaaaaaaccctccaactgtagtccttactacatatggtattgttcaaaatgaatggactaaacattccaagggaaggatgacagatgaggacgtcaatatatcttcaggcttattttctgtcaatttttatcgcataataatcgacgagggtcataacattagaaacagaacgacagttacatctaaagcagtcatggctttacaaggcaaatgtaaatgggttttaacaggaacaccaattattaacaggcttgacgatttatacagtctggttaagtttttagagttagatccctggcggcaaattaattactggaagacctttgtatcaacgccttttgagagtaaaaattacaaacaagcatttgatgtggtgaatgcaattttggaacccgtgttattaagaaggacaaaacaaatgaaagataaagatggtaagccattggtagagttgccaccaaaggaggtcgttattaaaagactccccttcagtaaatctcaagatcttctatacaagtttctgttggataaggctgaggtttctgttaaatcgggtattgcacgcggtgatttattgaaaaagtactccactatccttgtccatattttaagattgaggcaagtctgttgccatcccggtcttattggaagtcaagatgagaacgatgaggatttatctaaaaataataaattggttacggaacaaacggtggagcttgactctttaatgcgtgttgtttccgagagattcgataactcattttctaaggaggaattagatgcaatgatacaaagcttaaaagttaaatatccagacaataaatcgtttcagtccttagagtgctccatctgcacaacggaacctatggatttggataaggctttatttacagaatgcggccacagtttttgtgagaaatgtttatttgaatatattgagtttcagaacagtaagaatttgggtttaaagtgccccaattgccgtaaccaaatagatgcttgtcggttgttggcattggcacaaacgaatagcaactcgaaaaatttggaattcaaaccatattcaccagcctccaaatcaagcaaaatcactgctttattaaaggagcttcaattgctacaggatagttcggcaggcgaacaagttgtcattttttcccaattttccacatacttggatatcctggagaaagagctaactcatactttctcaaaagatgttgcaaaaatttataaattcgatggacgtctctcattaaaagaaagaactagtgtattagcagattttgccgttaaagactatagcaggcaaaaaatcctattactctctctgaaggctggtggcgtgggtttgaatctaacgtgtgcttcccacgcttatatgatggacccatggtggtcacccagtatggaagatcaggcaatcgatagactgcatagaattggccagacaaacagcgtcaaggttatgagatttatcatacaagatagcatagaagaaaaaatgctacgcattcaagaaaagaagagaaccatcggtgaggccatggacacagacgaagacgagagaagaaaaaggagaattgaagaaatccagatgctgtttgaatagtcataccacatactcatatataaagactttatttattattattttcaacccgaaagaactaattattcttcagctacttcatgcaacttctattatcttccttttccgttacccgtatttttaagttgcaattattaaaaaaacaattaaaaaaataagaaaaacagcgccataaggcatggacgatagaaatacgaagacgaagaaaatcatcatcagtcgggatcaaataagagataattttgaaaatcgaaggttttcattatgacagaaagtgtaggtggaaataaactagtagaccttttggtaaatgttcaatccattttgaatgctgcctctgtgaaatgtcatgtagtagatgaaagttttccagccaagttctttgagaaaaatccggataagatatatgaatcatattgtaaattcattaaaaatagaagtaactctgaaggtttgatacgtaatgaagataaattagttttgacaactatcaataagaggtttgaaaatggagagtacgaacccatacaaggtgggttttataaactgtatcacgacattaagctggtttgtacaatcctcattcacttttatcctcagggtacaagaaactaccaattagtcgacaagttctacaaattttcttcagagcttttattacgagaatgttgtaggataggaattgctctaacgcaaactaataatattaaatcaagaagtggtaagttgttgagcggaaacgagatggatgaatacgacgatgacgatgcaacagaactagacaaaataatctcttatgattttattaagatttctatgaattacacagtgccgatttctcaaacatatcaaataagaacgaaggatatggaccttttttcttcgataatttctaaatctaatcttgacaaaagacctcatgaacttcctaatacaaacttcaaaataaacaacgtcttacctcaaactgatatagaaaacgaagctccaagattaggatttgtaggcgctaatactagtaatattccggaccctacgttaccgccaactgaaatgatgactagatttttgcatccaaattggtatgctttacctacaaccgtctggctaaaatatggtaattataattcttgggcaccttcctttaatgaaaacggcaccgttgtggattcgacaacaaggggtcttatttggcttgaaagaattggttacatggacttgtatgaaaaaaatgaaaagaaagtaaaacaagaagaattactgaacacgaatgaagaaggcataaacaggaagcagaacgatgaaaacaacaaaaatgttgacggcaaaagcaatggcgttcaggacgatagtggtgataatgataatgatgcgactatcgcttctgtaaattcagagagtactgagaataaggaacaattcataatcaagcttcaaaacttatataattggacaccatctaattacattggagatgacgaaattgagaactttcgaaatggcacaccagataagttggtttcagagtctctcttaaaacttaaaaaacttagaaaggagaggattttaaataaagttttgaagcctactacggaggaacgagaactatacttcaaagtgaaaagaatactaaaggaggttatcttagcaaagaaggtttccaaggttcctataaacaatgtaagggcctttccagtattacaaacaaactataatggtagcatacctgtggtaagggcgcaatcaggtcgtaaacggaaacacaagaaataaatagtgtcagcggtagtggaatcaaagataaataatgaattatctttgttttagtttcatgaaagctcatcaagtcttttttgactaatgtatgtttatattttgatattagataaagtatgcatttgttctgaaggctatgcatacgtaagtatatacttgggttgtattatgcagaataaagaaatgagagaaaacaagaatcgggagaaaacgacacacttgacaataaataggttccattaaaaatggatgtcagcacctaagaggtaggaaatcaccaaatagcagttcaagctcccaattaaagcccatacgaaaacagaggtataggtcaacaaacgactgttagtaaaatcaactattttgctgtgtttggagttcaatggagtggtttcatcagcaatggcgttaacatcggcaggtgctcttaccacaccattttcgtcatgaacaaccatcaactttctatttgcggtaaaataaattaaaggagcggatacgattggtaaaattaaggataagaccacttgagaaaaattcaaaatatctgaaattcccttttcccccatggttaaagtaacaaataaacatggtacaatggcaatcaatctggtgcacaatcttgtggcccaaggtggtaaagaccactgtaaaaatccctcagaaacgatttgcccggcaagtgtacagatgataccggcagattgaccagaacataacatggccaatgcaaagattaaccctgctgcaggagaaatgtagtggaccagtagtttgtaaatagataacaaatcagcatcctctgcctcaggttggcctgataaagtagcacctgcaacaattaaaatagcggaattcacaaaggtggcaattaagaacaaagaaatgattagttcagcgtacgcatagtttaacgtgtattttatagcgcttaaacttgggcgagcattaactttaccgtatttcttcaaatcgtaatcgtgcaatcttggtttaacaatggatgagcccaagtataatgaatgaggcatcacagtggcacctaagatacccaatgaaatgtaaagagcttgttgttccttaaaaatgatatttgaaggcaaaaaccctttaaacaattcagctttgtctgggattgaaactttaaacagctccaaaacaaagcaaatgcaagttccaatgaccaaaatcccaacgccaaattcgaaaaccctaactttttttaaggactggccgtttggtgtgtagaacattaaaattaccaaaacatctagcaccgttaataagacaccccaagttagtggtattttgaaaagaatttgtaaagcgatggcagtgcctacaacctcggccagatcagtagcaatgattgccacttcagcgaaaaggtaaagggtatagtttagctttttaggcaaattatgacgacagttttcagccaaatcatagccagtgatagtacccagcttcacacagagacattgcaaaagtacggcaaaaatgttggatataaaaatagagaataataaggtatatttgtattgagcaccaccggaaacactagtggcataatttcctgggtccatataagccacactgactaatatccctggcccaataaatttggcaaatttttgaagaatctgcatataagatcgcattttttttctcttgtgatgctactactgttatcaattagcttggaagaacgatatatttaaaggagttcagaaggaaataatagtttgggtataacaactgaaaaaaaaaatgaactaatatataaaggaaccccgtatatttatgtgaagtgatctttgtcttctagctcctttgaaataaatattcaattatgcaacctcacagaatcagatgaatgagatatatacagtataaatacctttagtcgcatgacaacaggatgtcgtaacaatgcaatattagagcatttttaagttgacccaaaacggaaatttcaaggtgcggaaactggaagagaggcagggcgggcaacagggtgcggttaccatgagttacaaacaatggtctattatgaagtaatctattgtgctgagtggtgatagtgcacccgatcatcaggggctgtctggcgtgaagaggcaccattcatttgtcgtggcttcaatgtgtcccggtttcttcacatgcgctcgcaaggcttgcaaaagactggaagaagggcttgtggcatcgtccctcgatcgtaaccacagagtttctttggcaaagttatcgctgtcatgcttaacaattttttcattcttcagggtatagacgtagttgttggtatactcggaaaaatgcatgagtttcggccttgttttgtgcatgcaggatgctttctttatataattatcagttactttttttttcgaatttcgtggaatagccatgtccacggtattgtttcttttaccgtaggtttgctgaagctttattagttcctttttttctgtatttgaaagctgtctttcgttgggcattcctcttttattggcatctccacaactagtacgtttggcctcaagtgagttttcgctcagtttcttgttgacgtttcttatttttgtgatcataaagggattagaaatagaagcgtccttagaaagttctaaatcctcgttctctggaatagtttctatatagttataagttaatgacgagggtaatgttgaggatccagctcctgctacttcactattttcgcttagttcttgttggaaattatgtcgccaattagtaccgtcctcggaagccatagacccggaactcgaggttctataacttgaaatggtcagctgagtttgttcgtcaagagctttatcctcgctaaattttgtaggtgaaggagtagcagcgacaatggtcgtattctctaagtttgcttcatcgtaaaaagttggtactatcaaatctgagtttttttgtgggacgtcagtcttgtctttaccactaacagcaccacagccctttgatatttcattttctgcgtcgggtgtaggtatcaccagtgttggagaagttttttcgttgatagaagactgaacatgtttatctcccagcatatttgtttcgatgccaattctctcctccaataacaactttaacttattctctattttcttaagtatcacttcaaaacttttgatcatcacgtcatttttctttggttcgatatttacgtcaagaagctttgtatcgcaatttaaattaataaaccaaaccataggatctagtaaagagaaatctctatagattgacgatagtaacttagaaatagtcttccccgtctccaagttcaaagataacgctctctcattaacagataaaaatttaaatcgtctctttatattaataacgtcagactctggcaccatcctcggtaagatcaaatctaaatttattttttcgtcgataacaaagttttcttctacaataaagttcagcggcacaggcttttttagtctagctagtagggacaaacttctagctctagaaatcttagggtctaacgtttcttgcatttgtttacgctctatggcaccatttttttgtaatgacaccaacgaaaaataaaaccgaatatttctatgaattagagaataatggtttattaaatagattagttcatcgaatgtttttcttggcctcgaagaaatttcgagataccttgctcgtaaccctcccagaagtttccttaatgttactgtagtccccacgggacaagataccttgtacctttttccattggtaataccacccttactatcaactaaccatttttctccaatgacatcatctgcagtttttgtttcaacctgcattgagcctttctggttacacaagtttgacaaaagaaacaatgcctcacctctgaatccaagagtagtcagaatcgaaatatctccgagactactcatctttgatgtagtgtgttccaagcacatagaaggtctgtcgataatatccacacctgatccatcgtccttaactgatatatattcacatcctcccgtggtggaatctacatcgatgaatacttttttagcacccgaatcgatgctattatctaataattcccttacagcagctaccggaccgtaaataaaggaactagaaacaatcttccattgggattctggagataactgatgtatagtcatccaaaactatgaaaaggcgtctgttcctcaaaccgagatgatgggatgtgaaataactttatatgtttataaaagtgattactttttcttgtatgggcgccaaaaaagggccatgtatatgagggatatggacgatagtgagattatttaaatagcaaagactacagtaaaagcaaaaaagcattgtgccagggcaatatagcgagtactacttaaacccaaattaggtgacaagtgaaaggtttgttatgcgcaaacttataaataatgcagaaggtaatcttttctactgtactatatgttcacattgcagtgttacgaataaatataaggatatatagctctgcttaaggggttttcttggaatcgagtcgagttattctagaaattgttaaaaataaaggaggataaaagtaaaaataaatggacgcaaccggaatcgaaccgatgacctcttccttgcaagggaagcgcgctaccaactgcgccatgtgccctaaaacgcgtacaagggagaggaaattatttggctacttagtaatgttttcacaggtaaaccctctactgtggctaagatgagtgttattcttcaacctcatagaaagcacgcatgttactttcatacgtaacgggggtaatattactagctgttagaataagagtcaacgatcataattgactagtaacacaaatactactaaacggatgatgttttagagtttcattctaacaaattgataatgtagtaggataatgaatgacaaagtataaaagaaaggaagacaaagtgattttattattagaactatcaactccttttcgtgaattccaagactgttaagtagaacttctagtatattttgtatacctaatatcaacaacgaaatcccaacaattaatacgaagtcacccattttctgataattgttacgtgcaaataatagaactacttttgtcgaggtgtaatctcgtattcagactatatggtaaattattctcaaaggttgagtaatgcaagaagatgatattgaatactttgcgtaactttaccaattatccaatatgcaacagtaaaatgataccttcacatttcaagctaattccaaaataatacatattaggtaaaatcctcaattaattgcccggttttaccttcagacatcgctccctttccattgacacatctatacccttcaatgaacccgctatgtaatatcaacgcatcgtaaaaatagaataataatgcagtagtacatatccagcctagctgcaatctgaatagctgtgatagtcggtgtaaattaatagtttggtcagttttaaaaaaaaacctaattttggtacaaaagtagaagctgaaagcagtcattgataccaataacaaatactttagctgaaaccatttaggatacttttttctggcagcacagctgggacatactaccttcgaacatctctttggctttgttttattttcatttttaaaatgaccgttctttcgatataaaaagaaaactataataacgagggaaattgttaccgcccccagaatcatatctatgatcttaatgatgattgcttttgggtacttttcaatcaaattatctactgatggcactataaaacaatttataaaataaaggctacaaacggcttttgttaatttttctataattaataaggaattagactttgggatctcatcttggctttctgtcgcactaagttctgcctctttcattatttcctatactttgaaggagaaagtaaactttaacggcaagttcctgtcttaactaccttttagttctcgtgtgttgtgaagggcctttgagaaaaaactcgaaagtttgttccgtacttttaaactttcaattttttaccaaaaaggctatttaccgctttatgggaagatcatggcaagtcaaatccacgttaaatggaacaagattaacttgccacagatcaaatgctgaattgaagagaagttttaagcattaagattcttaatatgatcattaatatatcagtacgtgtcccaactggaatcgtataaggttcttgtaagtacaaattgtatgcagaaatttaaatgcgagaaaacttgaatctccccccgcatttaaaaaatatctttttgaacacagtgcaactgattaaaagtacctgtaatacatatatatgtttgtatacgtatgtatatctaattatttcttaccgtcaaatcataattatttttatccgttagtaaagcaatccagtgctaaataccaattgtgaggccatcggcttagtttggaacagcagtgtagataccgtccttggatagagcgctggagatagctggtctcaatctggtggagtaccatgggacaccagtgatgactctagtgacttgatcagcgggaataccagtcaacatagtggtgaaatcaccgtagttgaaaacagcttcagcaatttcaactgggtaagtttcagttggatgagcagcttggaacatatagtattcagccaaatgagctctgatatctgagacgtagacacctaattcgaccaggttaactctttcgtcagagggagataaagtagtggtggctggggcagcagcgacaccagcagcaatagcagcgacaccagcaacaattgaagttagtttgaccattttttttcgattgaacctttgtagatctttttagtgaagatgtgagctcactcgaatgtaaataacaatgccaaattgtcggaaagagttaatcaaagctgctctatttatatgccgttttttaataagcgacggacgaacagataaattgttgaatagctatttcactgctgatatttctcttacttgggctcccctaccccatactcttcaccactacaaatatgcagttgccctttcttcaacaatgctttttttatagatctcgtatacggatccgcgcctttgtactacctatatcttattatgatatatacaggagcacaggaatgttcggtacagggatgatacctttaaaggaagttttggcatgccttgacaacttcaattaatctttggccaagaaaatgaaccagaaatcaaattttattctgtgtcctctgaacgagggcaatatccagtgtttgacactaaacggttgttaggagaaaaattgaatgtttcccaaatcagaaacattaaaatccctctatatgatcagaggagtcgtacctgttagggtatgagcgaggaaacgtgattgagagttataaactgaccatacgaagagttacggccattgattgggttcatgacacccagggaagtttcttttggcttaaaatcacaagtcttgcaattgctgtatgtattgcatgagtgaagtagttggcatctaatggatacccacttagggagtttatggatgaatcttgtcttcatagggtagctcgagagtgttttttaatctagtgatatccacttagctaagcgcggctggagatacaatatttacaaaggcaatttcaaaagtaggagcgttttcaaaggcctgctccattctccgtcgaggtagtagaagcaaatataaacggttaatcttgctgttttccttgttttgtctgttggttttcgcttgctgaagcctgtggttcaacagtactcggagaatcggccttatctagtctccttctgacctgtaatgcgtaaaattacgacaaacgtatttcgtgaaacaattgataggaaattgtcatttgtttgttaaggcagtgcattgaggctctttaaaggtactttagaagtttatgttattatccttctagcctgatagaacaaaaagtaaagaattgttattcaaaaatcagccatcatttcgtttagtagtagcgatcgcaagtagtgactgtaagagatagaaatgtgtacttcagtctggaactggggcgcttgtgaaggatgtgtgccgatctcaggctgttgatgaaggtctcttcaaatactatattattatcttttagtaggtcccaggaagtgccttattctcaacatgttcagcgtttatctttctcagcctgaatgtatttcaaacgatgactagaagagattagtaccccttatataatcctcgaaaatgttgctatctcagtgaattgaaagttcatgctgacgtctttatcagcgttatccattgccttgttcttttcagtgcaatggcagatgttacgagggtcaaataatttttgaatatatatagaaatggctacttactataattaaaaataaatatgaaaaataaaacttcagtaccccacatcattctcatttttttctgtttgtttgatttttaggaatttggctccatcatgaacattcgttagtgtatgatatcactttttcattatctcctattgttactttacttttcatatagatatccttcatcccgtgtaggtctactacgcaaaaatgaattctagtaattaataataatgatataaaaaaggctaagtgcacattactaaaaacgaaactaagatccttagtctgagttgatatcacctgcgaaaatacctttttctctttgatcatcccatttttcgatccagtctaggggacataaggcgttataggtcttccaaaagaccttgcacggagcaaaatcttcgcccttcatattaacacacttgtgataatccacataagattgccaacaatgctttgtttggttttgttggggaaatctagcatcgaaaccaactgtatgtagtggagagttttcttgatcagccatgcctattatactgtatttatgtgcttgttcctatttgtgaaagcaaagatactctatgtattcttactaaaatatttgtatatctctgctataacattttaatgcaacttttctatctggtgcatctttcatcaccttttaaagatcctgaagggatgggaatatcgggcaaaactacgcgcgacgcatttctgaaaattgattggtcaatgttatgaagctatatggtaaagaatacatggtgtcatatagatttatttgaatctctcgagtgccttttgaaccaattgtgtgttgttttctctgtctaattccttgagtaagcgtattaattggaaacacatgtcccacgaatcggtagctttaattgggtctgtggcgtttgcagcacttgtcaccaaaagctctaagactttaagcattaattcttcatccttcaataaattagcgacagatttctctgacttttttgtggagttatcatttagagctttgctttcctcagtccctaaatctgatttcttaaaatgtagatcatctcccaaatctttctcatcgtaatttaaaaacactaacagaagtacgccaagcattttagcctcattttcttcgatacagagtgccaataaatctcttggtgtcatctttagattagtgaagagatggttccagtatttagtttcgatcttccttaaacaattactaataatttctaacataccactgtgggttggtggtgaaatattatgttcaggatcggtgttgtcatacatcttaattagtttcaggatatcatccaaagagtcgcttcgcagtatttttgtagacaaaatcttttcgagtgcaaatttgtaaggctttaaaaaacgataattgtgtgaaatatcctccaaatctgtgttgtcttctaatttggctaagattaattggtcgaggtatatttggtgcttcaccaccaatttggaaaatctcgcgttaaaaatgcagtgaagtgtatgtgttgtagctgtttctggggtggttgatattgggtacaaatcttcttcgattggaatggaaactagcggcttcttatcatcccataaatcttccaaagagtatacgacgtaattatggccttgaactacaaatatttcgtccctgataacatcgattattttttctatgttatccaacaaagtcaaggtttgccagccccctccatccactttgccaagctttataaatttcctatcggcaaaaaataacaagccctccttcatgttagttatccactcaattttgttgggtaaaacatcaattggaatgttaattttgagatactggtagaattttttgatgatgtttaatccacatggatgtacagtagaaattacatcgaagacaatcgtctgcgtatcagtaactaagataatctcggcagttttaagcaatgcatcaggttgtttttcagaagcattgtgattcttggatttcattttcaacaacttataccgggataaagtattaacatgtaaactgaaaacaatcgtattctctggaacattgtattcccaaatgacataatcggatagttccacgtccggattcgcttcttgcagtggaatctgcagacatttcagatttgttgagccgtcatcattcttcatatgacaaaccaaataattatcacctagccaatgtaaatccaacacgttttggtcagcaaaactagaccacatattggtctctagattgtggataagcagtatgtttttgttcgacacataagtagcaaataacctcaaggaagaattaatttttacaaaagcaatatgattattgaaagtctttgtaggaagttttatgacttgtaaattatcattattgattgaagaacttgtcacaggtgaatatatgattacatcattgttcgtattggttaatacgtaacattttgggtttctgaaatcaaattgtgtttgttttatttcttcccataatttccaaacttgatattttccggaatgagacactgttatcagtgatttatccaagcatacaaaatcagaaattttatattcagccgcctttttctcatttttatccttgctgttgtcattattgttatcaccattataatcatcttcgtcaaaatatgtagcgaatagcagatttccaaattctgtgtaaaaatgaatgttaacactatcctcagaaaccaaaagtaatattttatcattaattttatcgcaaagttttatcacaaatggtggtttccaagaatggcttacttttttaattcttgtatcaaagcagattattttttctttgtaaacaaccaccaggtatccattaacttctaggcaagtcaaaagttcatctggtgtgtccgttaacggtattgcttcaacagcttgcttttcaatgtctataatgcttacaatagtctgcttttcgacggaatcatgagataaaaccattaattgtttattacacacaattgtcttggatcccttcttcacttcaaccaacgagctcttgctaactttaaaatccgatattgtaagtatttgtaatccatgagggaataaaactatcaaaacttcttcataacgcccatccccgactttggaaaatgtcttgatgccaatcatgtctatgatttcatagtcaaatttaagaactacttttaaacgaagttccagttttttcacggggagttcatcaatgttttcttgattagaaagaaagtgtaaaaaccctttttccttagttatgccaaatccattctgtataattcttgaagaactatttttatcaaataccgtgagagtatcatcatcgttgttatagtcatattcagcactgttcgcttcttcttcactcattaaaagaggctctatgacgggtatgccgtattctttgaaaattatttcatttgtgcagttttttaaaatttggtatgttaaaagaaagtttttatcagtcattacgtaaaatatcagctttccctggtgccacaataagtattgcgagtccttttttgaaataagcccttcgatgatatcattatatggagctgatcgtttcattgatctgttatcgccaaattccttaagagaagccattgttcgttcatggctagctaccagtgccattggtttgaagttgtaaatgagcactcttgttggggtcagcatgataagaacattggcctggggtagtgtcattgattgaagaatattgcaatcatctattttagtaccttcacctaattcggcgttgcggggtggaattctaagcaattggggcggactgactggccataagtgcattttccacgtgttcagtttcttgcagcttccggtcaatagcactcttaccttacctttttttttgtagaggcatttaggtgtatttttttcagactgtttgatgaacatcaaaggcgtcggtattgccgaattaacatcaaagaacaaaagcctgccataaaacgacagaaaagacaagattttggccaagatggcaacgccattcagaagttataataatatgttaaaaataaatcgtttgatactgtacaaagttgatgttcatcgttgtcactaaaaacgctcttaaaatcgaattgtccattgaaaaagtacatatttatatacatatctgtataaataatacacatattataaaaaaagcgaaaagggatggcggacctcccatggaattaaattgccaaatttggttgaggcacttaaagggcaactgcaaagattccgaacaacgccatggggaaatataaggttttggcatgggcaccattccgtgattgactagttctggatgttgaagaagagtttgatgcggatataagtgctgttgtactgttttcttcattagccatggaaatcatggactggcctgcgttcgctgtcgagaaaggaacagaattggaaacggagttttgttggctggcataagaggagttagtcatggtagcttctgtctcacccgttatgaagtgttggggaaggtatatggtggtggcggaggctttgtttagcaaagaggtataccatggaaaggccgtaatgaatgtttggaattgagtgaacggaaaactctgagcaatatcagattgtaaatctgctgttgaggccaaatcaaccatgtgatagtagtagtcagcaacaggttgaggtagagttaaatggttttgcatcatgtatgaggtatactgtggaaaagcggtgtcgaaatcgtttaaaaactccatgaagaatgccatgtctgcatctgcagctgcggacctggcaagtgtatcgtcattggaactagacgttatagttttggcagcaaaactgtggctgattagaaagcttaccaggagaatatttttaatgagggagaaagaaggagcaaatatcattgatacgcaatattgtcaggaatgttgtaaatggtccgtagctggatatcgaaatcacttgattagaaacaatacgccggaatatgatcaggtaaagcagaataacaaagaataaactttctcgattgagagtgtctttttaaatcatccaagctcttgaattttctagcatagccttggatgacagcaataaaaaatttgccaggatttttccctatttgggcgttcaatgaagataacgtttgaaatattaaaaactaaaaaaagaaaaaggtttgaagcaattaataatttattaagttttttttatttatcatacttaagaatatggagaccacgggttttcttacacctgcgaagaccttgaacctaatatatttgtttaagaaaacaaataagcgattgtttctaacattaaaacaaagtaaagacatggcttgactgaacctacacctcctgtgcttgtacttgaacttatagtattagttgtttgagagctttttgttccatttctcgacgaagaaggcaatggcgtgaactgggtgactaccgtagaatttgaggattggtaatttatagatgttatgacgctggaagtgacttttggtatagacgacgatgatgaaaagccggtaaaattagcagcagctaatgaaccagtaataatgctggaagaggtggtgcttggaagatgaagtagttgatcgttagaatttccagtgtcaagaaaggtgtattgcactttctgtccaagggcagtattcaaatcctgagcatttgaatctgtgagaagttgcgcttgaacaatgaacagttgtagtagcacaattggggcgaaagctaaagagccaaattgactgatcttcatattttttttgatttgttgacgagctataggatgatgaaacggagggatatcaaagtacgttcttcaagcttacaatttctcaaggtgctttactggtcaagatattcaatatatagctaaatatttatacaaaatgtttgttgacggtttgtttatagtgttttcaaaacaccacgaaaagacttcattcttgcattcttttttctacaagatgagtctatacatctgaaactgcgacgccattttttccgctgttcggggcattcttggccaaatcctcgaaagaaataaaacgtcaaaagtaaaaaaggtgggctagacgaaacgttattatacgtcataattgtagccgtgtatgagtgggtggaacttgtataaataaacaagttcttacttatcatattctcgcatgcaatgaaattctccagattatgacgcttaggtctggccagacggctaatgaggtccagaggaaatagaaggattgtaagcggcctccactaaatttcgacccctcatacatgcttgttcaaacacaaaagattgaggttgaaaacttggcaagaattgggctaggagaaagtggccaggtgcttcttgttcagaaccaagcagatatgctagcacaatgtgcaccgttctatttttttctatggtgtgtttacatttcttggcacattgcgttcggtttcaaatttgtataattattattggagcgagacaggcgtttctgtaccgctgttatttttaacatccactgcgttttatgtatctctaaaattgtgcgttgcctttcttttgtttatatttttgttcaaaaaatgagttattaatgatttttcatcttcggcttaacggtcttgaaaatatttgttaagacaacagtggataaaataaaactaaacaactcaagcaaaagtattccacttcttaaacaaagcccaactgaaaggttgcgaaatactatgtcattttgatctaatcatctaatgctcgagaaaatttcagagccgtaatacttaagtaatcggaagaaaagtatctcattcttcatttttctccaaatatatacatcttatgtgaaaaattaattgttttctccacctcctttgtgtggtgggcaattgtgtgcttccgagtaaataacaaaacataaggataatatataattctgtttttttgtctaaaaaaggtaaactatatataacaaacacagtatagaaacacaatatatcggtcactgggtgagtttaagcattagcagcaatggcttgcttaatagccgctgggttggcaccaacaacctttgcaacttccttaccgttcttgaatagaagcaaagttggcatagcggaaacttcattcttttgtgcaacatcacccaattcatcgacatccaatttatagaaatcagcttgtgggtattgttcagagaatttttcaatcattggagcaatcattttacatggaccgcaccaagtggcgtagaaatctacgacaactagcttgtcttgagcaattgcagagtcgaattcgctggcagttttgaattgagtaaccattatttgtatcgaggtgtctagtcttctattacgctaatgcagtttcagggttttggaaaccacactgtttaaacagtgttccttaatcaaggatacctctttttttttccttggttccactaattcatcggtttttttttttggaagacatcttttccaacgaaaagaatatacatatcgtttaagagaaattcttcaaatttgtaaagaagcggacccagacttaagccaattcaacagactgtcgtgtcggcaacttcttgtctggtctttccatggtaagtgacagtgcagtaataatatgaaccaatttatttttcgttacataaaaatgcttataaaactttaactaataattagagattaaatcgcttattgcttagcgttggtagcagcagtcaacttagcttgttcaaccaagttttgtggagcatcgaagactggcaacataacctcaatcattctgatcttagagttgtcgttgaaagacttgtcttgggtcaacttgtcccattcaccggtggtagcgactctgtgggtttcgtagtccttagcaccgaaagttggcaacaaggataggtggtcccaaccttgaatttcgttgtattgagcctttggaccgtgaatcaacttttcaatggtgtaaccatcgttgttcaagacgaacaagtatggcttcaagccccatctgatcatggtggagatttcttgaacagtcaattgcaaagaaccgtcaccaatgaataagataactctcttctttggatcaatttcttcagcagcgaaagcagcacccaaggtagcaccagtggtgaaaccaatggaaccccataagacttgagagataccgtaggtgttgtttgggaaagtggtttggttgataccgaaagcggaggtaccggtttcagcaatgacaacatcaccttcttgcaagaagttacccaattggttccacatccattcttgcttcaatggggtagaagctgggacagcagcgttagctggagttctagctgggacagcaactggcttgtaacccttagcggcgtcagcaatattggtcaacaacttttgcaaaacgaatttcatttggacacctgggaaagtggcgtttctgatcttcatgtggtcggagtggaattcgacaatgttcttggtcttgtaagagtaagagaaagaaccggtgttgaaatcagacaacaaagcaccgacagacaaaatcaagtcagcagattcaacggcttccttaacttctggcttggacaaggtaccgacgtaaacaccaccgtatcttgggtgttgttcgtcaatggaacccttacccattggggtgacgaaagctgggaattgagtcaagtcaatcaacttcttagtttcagccttgacgtcgtgtctggaacaacaagcatcagccaagataactgggttcttagcatccttgaccaaagccaagatggtgtcaatgacttccttttcggattcagcatcgtttggcttcaaagacatgtcaattggagtttgcaacaacttagctgggacgttcaagtcgaccaagttagctggcaaacctaagtagactggtctttgggtgacgtaagtggttctgatacatctgtcaatttcagctggggcggtagcaatgtcagtgatcatagcagtggtttcagaaatgttggcagacattctgtggaaaacagtgaagtcaccgttacccaaggtgtggtgcaacaacaattgcttagcttgagaagagatggatgggacaccaacaacgtgcaaaacaccgacgtgttcagcgtaagaaccggcaataccgttcaaagcagacaattcaccgacaccgaaggtggtgatgatacaagacatacccttgatacgagcgtaaccatcagcggcgtaagcagcgttcaattcgttggcgttaccagcccatctcataccttcaacttcgtagatcttgtccaacaaggacaagttgaagtcacctggcaaaccgaaaacggtgttaacgttgacttgctttaatctttcgaacaaatatttacccaaagtaatttcagacattttgattgatttgactgtgttattttgcgtgaggttatgagtagaagataataattgagaaaagaatatgacaagaaatatgaaaataaagggaacaaacccaaatctgattccaaggagagtgaaagagccttgtttatatatttttttttcctatgttcaacgaggacagctaggtttatgcaaaaatgtgccatcaccataagctgattcaaatgagctaaaaaaaaaatagttagaaaataaggtggtgttgaacgatagcaagtagatcaagacaccgtctaacagaaaaacgggcagcggacaatattatgcaattatgaagaaaagtactcaaagggtcggaaaaatattcaaacgatatttgcataaaatcctcaattgattgattattccatagtaaaataccgtaacaacacaaaattgttctcaaattcataaattattcattttttccacgagcctcatcacacgaaaagtcagaagagcatacataatcttttaaatgcataggttatgcattttgcaaatgccaccaggcaacaaaattatgcgtttagcgggcggaatcgggaaggaagccagaaccaccaaaaactggaagctacgtttttaaggaaggtatgggtgcagtgtgcttatctcaagaaatattagttatgatataaggtgttgaagtttaaagataggtaaataaacgcggggtgtgtttattacatgaagaagaagttagtttctgtcttgcttgtttatcttgcacatcacatcagcggaacatatgctcacccagtcgcatgttgttaccctcatgaaacatgtatgagatattactttgaataggttacttgcatgcatttcggcgtgcgggtaccacctctttgcatgagcttgttcctttttcaagttgaagactatatattttattgagtttatgttatggggaggctaccctttacgtcctggttgtcccttcccgccttgatttggccttcattttttcaattctggcctttagggtagatgtcactgcagcggcacgtttataactttcttctgaggcaaaactatcgttgaaatcgatatccaaatcgtcggagacactgctcactccagtgccgttttttctgtacggccgtatgttaagagagtttacgcggtgcggcaggtcgccgatggactcgcttgatcttctttcatagttgacgtcctctttccttctgacatcttcctcctccttaaatggcaaagcggaagataaagattttactccatagttgcttgacacggtggaagaaggtatggagtatgatgaaatcgtacccatcgattgcaagtttgtatcatttcttttcttatttctatccaattcgatctccatgtttctaagctcgttttctagtgacagtactctatcagacagcttattgacatcaatctccttggatcttaattgaatgttcttttcgttcaatttagactgcgcttcctttagttgctctcttagcatttcgttttctttaatcatttcgatcttataattttctgtattattcatcttttccaataggctttgtctttctttggtccatatcatctcattattttgtagtttttgcagtctgtacttgtattcttcaatcaacttttcattcttgtcagtgctattagctactacgttttttggcgttgccaaagacttagacgtcaacaggatcctcgatttattgttagcagctaccattgatggttttgatgcggaggctactgaccctattgggttcactttacttttgttatcatttctcaacggtgaagatgccactctcttggagggaagtacagaactttttttcagcagaaatttattctccattggcccagtttgtttattcgtttcaatagtgctatgggtactaccacttgcaatactgaaattaggtagagttttgaccgtttcttcaatttttttccttttcaaattatccaagtgctctaatgttttcacaaaggtattcatgccaaatattttaattagaatggcgaaactctcaaatccaatagttcttatagcaggttgggtgtcgttgacgatctgaatcacaattggtaccacttcatccttcaagtatctttgcagggtcgagtatccatctttttcttctttcatgcttgcattaaacaattgcgtacactccattctgatttgaggtgtcttgtgcttcatatgctccaaaatatctttcaacatatcttcattacgtccactggaggctaatggatcgtaatacttgcagatggttaataatgccttcctaatggcctctatcacagaaggtttcttttcctttgtcctgtctaacaagggagtgaagactagtgaaatataatccttggaaaagcctggtgtttttagtttgtcgcagattaattctactgattgagcggctagtgcaacagcttgaatgtttgcatctttctggataatatggccatatatccccaataagttggaataattttgcgaggagctttttaacttcttagtctgcgatagaacactatcccaaaattcttccaacgcttccactctatctttccatttggacgacgttatcctttcctggaagtccttaggcagtttatcgaggatcgtctcctccggtagcatactgaaggtgtctatttgaactccactttgctgttttgatggtggcatatccgtttccatccccatcaatgtatctccatccttatctatctgatattccccctcatcattcgataatatggactttcttttcctggcttcctcctcttggcttcttttcttttccaattctcttttctcccactcgaataacattttcgatgacgatggctcgtcaccaacttttgcaaacaatttatgaagatctttcacttgaattggttttaattttttaaacagtatctcctctaacaagtcgctattgttgcccgtaaccttatagatctcgacaatcaaattcatcgtttgtgatcgaacgtttctatcaccatgaccggctagttgaggtacgtgctttaataattctggtagaaacgtttgaacgttcacattagtgagcccgaatgcagccatcaactcataaacacaattgactgccgcagcaattaattttggcagttttttctcgaaaaagggtattaccaattccaccgattgcgtaatagatgtatcaagaccacatagtgagagtatacagctcatcgactgcgtcttcgttgtagcccttgaggacgttaagcccttttccacaagcaatggtgtccatgttgatattaaagtaatattatgtgcatttttcaaagacgatgacgcaaaggcatctattaaactattcaaggcaacaatggcttgttcttgagcgaccacattagaatcagttatatattgtgcaaataatgtaggatccctccagtaaatttgtatgttgtcatccctactgatgtcgccaacggagtttctaaaaagctggtttaattccttataagcttctaaacgtgccttccataacttgtacgttaatcgctcttctaggggtaacgctgtataatctacttcttcttctcctgacatagtcaacttcaaactctttaataagaactcaaaaatactttacactgtaaagatagctgtttctttgtagtttagtaatgctatttggtccctaggtctggtaggttctttatttactcttcctatggagtgtcaagcagacaaaacaaaaacaaaaacaaaaacaaaaacgacacgaaaaaaaaaaatagattcgttaaccatgataatctttgcaccatataaaggaaaagacaagattgacttctaaagcccagcacaaatattatccaactatttaactaataaatttttgactacttaatcttcagacacagattccttgtctaataatttgtttaattgaatattgacagatttatcctgcagcttgaacaaatttcttgcgcgaaaggttgctaggaaaatcaaaggtagtaaaaacattagaactgtatcgaaaacgtagaggcaccattcgtgctgacctatatagctttgtaagcccattaaaaattgtactactctgacaatggttctaccattaaccagcaatctcccagctaaaagtatagaattgtactggaaccattcattactatcccgcacaattttactaggtactgccttcattttatagtgaagaaaaagttgactgaacgttaaaaaggtataacaaaatatctgaataaaaagacccacaataattaggatacgcccagtattcctgctgttccataaggatgacaaccaaactcctacagcctgtaggacacgcccaatcatttctgccactacgaaagaaactgtaccaaatttcgcaggaattaacatatatgcctccataagaattagacgtgccatttttctgaacaacataaaaatactaagggcgtaaagtgaaggtgctatcaatagaagcaccgattgagcaatgaaagtcgaaatcgaggggctattgataaagactattttcaacacataacctacgaactctaaacaaatccctaaaacgaaaggaaaatgtgtccacatcaaaccgcgggcaggaaagtatattattgtggaattttcctctaacaactcattgttttcccagcgatgaatacgtctcttgctcgtgtgtgttgccattatgatctgcaccaaggcagaaaggattaaaatgccaaacagaacgacaaatgcaatcgctgcacctttgtgaggattgtatgcataaaaaccttcataatcagtcattgctttagtaaaaaaattcctattgaggcagttgagttcttttatcgataataagtctctagtacagtagtgagagtgtcatgtattcagtaccaagaagaacttatatgccttttataattcatcttataagttgctagacatacaaataatcaatatggaaatgtgcttattcccgctaatatccattaatatccgctgtcatttttcgcaactatcaccaagtggagagaggcttgacaaccaccagaaaaaactaaatcggcctgcggaacttttctcggaaaaaatcagttagaaaaagatcgtacatagggcccttttttgacagtaagattaaagagcaaaacgggacattatagatatgccaccatcaaatacgtgaattttccaagcctcataaactaatagccaacttgcaactcttataatgcaaaactttctccgtgaaagtgtaaaccaccatctgtcgcccatcttttggtgctttcaattaagcctctagggcctgcagcgagaacccatacttgtgacaaatattcagcatggtctctgccttgattcgcccacctgcaacattgaatagaatccgtctctgcatcacattcggtttgcagacaccattcataatccttatctccaagtgtaggcctcccaaagaacactttaacacctgcgggaattctgatctttttaggcgccgcctctaaacaaggatcttgggcaggtggctcaatgatctttggttgtctgaaaacgctcgatccgttaaacgaagaatgtgtagttagagttccttgtgcagtatttttccttgatttggatctgctaaaagcatatgtaaaatctatctcgtcatcagcattgatgtcaggtatatcatttgtttttggtgggtgatggtttctcaaggtagatttcttacttagaagggctgtgttctcattgggctccgtaggttggggatttccatcagataacatggaattatctcccagttctgaaactcggccgctcgaagaaatactcctgacttcatcattaatatcagcagcgcagtcatgatagtcaatataatcaatttctatgtcctgttcgttgccttcggtaccactaatatatatctccataccttcaaaattgtttttgaagtggttcaatacttccagatccttataatctctagaaacccaaaggagcctaacgtttacaccgttgaagtttagaatacgaagtaatggtaagccaaaggaaattcctgaacctccaacacacataaacactctttgcgctttaattagaaaatttaaaggcgaatttattagtgcagaagaattgtttcgaaatggattcttggaagatttcgtggtaatattaaaaggaacagtaggtttagaaatgaaactcaactcaggttcaaaagcccctgtaatgtaatacttttcatttgtacgtaatggaaaatgcccgtttctaataattaacctgaccaaattatcacttggaatactagcaatagtaaaaggatgttggaagggtatcaaatgggagaaaaacctccttaaaaaatttctatggtaaatgttgatccttagatgccctcctggtaggatgggctttttgggtaaatcggttaatgggaactccaaaagagacaatgatgaagaaatgggtactatcgtaactctcgtaacattggtgatatagagcctatagacgatttgtcccgttaatatgagcacatttaaagtggtataatatgaaattcctgggcgagcgtgataatgtagaaacaccaaaataagccatgtgcttacatagtgaacatagtaaaaaactctgtagctccatcgtctggcatatctcacagaagtgatggcaatcagtaggaaaaggccgagggcaataaccccataaatgttgggtagttttctcattttcacgtataacgtatcattaatgtacatgtaatagagatagaaccacgtgtgtagaatagattcaagcacaacaattctggaaatccatttgtggagaggtaacaatgctaagtataacgtgtgaggtaacggtgatggcctcaacgttagaaatagtaaaggtggcatcaaagcaacggaaattctccccattcgcttagtaatttctaacagatctccgttagcgccttgtataacaaaaaacgaggtgaaaacaaagcatattaaacatagttgtagtgactgtttgtgatacatacgtgttttgtgaacccatgatcctctgttgaaaacatgatgctttaaatggtgacatattttgaagaatttgtcagttagcaacaaataattcattaagggtataataacacatattataatgaaagaaattaaaagacatatctgagaatatttgcggactcttaaagttctaaaatgcttgtccacgtcgacatcaaaactgggaagatgttccttgaaccagctaacgatggactttaaattcatgctgaaaataacaacaaataaaatacagtaaacttttttagcggaacttctattgtaatttaacgatttaatctgaagagatgtagatgtaataaaactgttaaagtggcaacgtgataattaaaagcttggcaaaaataagagatcaacactagctttttcttttccacctaaatttgaagggaaataaaaaagaaattgaggctgtacagagtgttaatcttccataacggataccaccaaacgtttttaccctaaacttaaattttattacttattttacatgcataatggctgccatgcgtagttcacacatgttatttgcaccctttttctttttcaataacagaaaagagcttgggcattacgttttcaacacttttaatatttccttttacatccgtacatataaaatgtaaacccatgcattcatgacaattttacctatctcttaaaggcctttgtcacttctttatgggaatggcgctgctttagttttccgcctactttgaaaaatttaccaaggcgaaattgagtgcgctaggcggaagttccagggcacggtcaccgaacctttgtgctgtttcgaacgagggtcccgctggaggttgacggacgcggaaggagctggaaagatggaatggaaggactgcaacactcagtaagaaggttcgtggtagggaacatcacgttctctagttcctgtaaaaataatatgatcaagtttgaatcctcgtattgaaaaatcgcgagttattaagtgtgtaatttggaataccgaaatagcacaagaagagataagataagatactgataggataatgtctttaccagctacttttgatttgactccagaggatgcccaacttttgttggccgctaacacccatttaggtgctagaaacgttcaagtatgtacacatatcccatacgattatgttctatagatgataataggtctcgaaaagaatatgtccccgatttaatcatatttggaggtcagaggaccaaaggtaatttcggaggaattttgaacatgccgggtttagaagagttagaatttcacttcttagtgagggtaaggagaagaaactctataagaatatacatcctcgactgtgtcaaagattatgaactccgatgaaacagtaaaacgtcaaaattccacgggatataattcggtactttattggatatggaagaaaacattatatatgcacaaatgaacgctcttactaacataatttatctttcctctctttttttaggtccaccaagaaccatacgttttcaatgctagaccagatggtgttcacgttatcaacgttggtaagacctgggaaaagttggttttggctgctagaattattgctgccattccaaacccagaagatgttgttgccatctcttccagaacctacggtcaaagagctgtcttgaaatttgctgctcacactggtgctactccaatcgccggtagattcactccaggttctttcactaattacatcacccgttctttcaaggaaccaagattggttattgttaccgacccaagattagacgctcaagccattaaggaagcttcttacgttaacattccagtcattgctttgactgatttggactccccatctgaatttgttgatgtcgccatcccatgtaacaacagaggtaagcactccatcggtttaatctggtacttgttggctagagaagttttgagactaagaggtgctttggtcgacagaactcaaccatggtccatcatgccagatttgtacttctacagaaacccagaagaagttgagcaagttgctgaagaagctgctgccgctgaagaaggtgaagaagaagaagttaaggaagaagtcactgaaggtcaagctgaagctactgaatgggctgaagaaaatgcagacaacgttgaatggtaatcatttgaaaaccttgcaatgtgtgtgaatattgtaaggaattgagaaagagagataaaaaaaagagacagaagtattacttccttttctaatttttctttttcatttttttttttaaattcatctatcgtttatctttatctcatatatatttgcttctctctgaagcgtcatcatctatctgtatttttaatgcaatcatagtataaaaatttttaaccaaattcaaaaattataatattttaaaagtttatgcttttgtccttttatattcgtcatttggccattattaagcttttttcttttattaggtaggtggtttcaataattaaattctttaggggggaggctgacttcctataatattgaagataagttaaattaatgtttagttctgatatttctttttattattaattaaatttgcactattcgccatgacgggctcacccgagtatttattttgctttcgttatacatatatatatatattcttccaggagaaatacctgccttctctcttaccccttgctcaatctaaatcaatccgtgaccttaaatcttctagcagaatgactaagtcgcaatcgattttagaaatttgaataaccagctcagagatattactgacaaaaaacttgtaatggcactgttttagcaagtttaagataaatgtatccattaagaaagcattaattttattcggaccataataggtagtcactattagaatatctaaaagttctagaccaataccatctaatttgtgcttattcagtgcgttggtcataaaatttcttatcacaggcttgatgaaatccattatcacatttaatttcaacttgtcctttaaatggtagtataagttaggaaagtcctgatagaacttcccctcagtaaccgtgtaagaattcttgttgtccttattgtcatcgaaacgactattcaaccaggtaacgtttttcgtcaaattgatgaaaatagaccgggatagagtttcctgctcttcgttgttacaacattttcttattgctagatacaatgagttgttagcatactgactgaaaaatccggcttcgtctagttcgctatagtgatataaacatctcttgtatattggaagacgaaaatcgttcggtatcccaaaccaatataagttatgcttacttatcaccaacagcaggtccgtctcatcgccagatgtatgacaacttctcaaattgctccaaaacttttccaattttagttctcttcgaaataaatttctattttgaaactttaaatttaagatgttcctctttgtttccgatttaatgagattttgtatggatggatcagtatgagtgcacaaggtctcatcgttattattggcaattaatgataacgattctttttcactattgattttccttttattttcctgaatcaaagaatctacactcaaatttttttgtggtctaatgactaatgaagatgatcctgatgagttcctgttgttgtttggagtaaacaaaccatcagaaaacacagaagacgcagaagaagatgaagaagagtacatcgttgatctgtgattcggcgaaggggccacaggactcccctgagagtttgctcgaggaatggcaaagttgtctattatggggacagcataactaatgagattagtatctttgtctattgttgtgtccagaattgttgtccaatctgtggtcccggaatgtagggcctcttctttcaaatcgtttcttgttattctatgcctgctatggaatagccgctgactaggtggtacgtactcgtgcatgatattattaaccatgagttatagctgttttgttatatccaaagaatttggctaacgtatccttgtacgcgtgatttatttatatatacgtgcagcacaatatatatatatatgtatgcgtgcgcttggttatggctcagtaaaacgaaagtaacggaataagcgagggaagggggatctagcgatgagggaatggcagtaacagactgttcccttacaatacactcttgctaaattacatcaaggataatatactattttaaaacaaaaaccagccatttccctaaggacgcgaaacttttgtgacgcgtttcaaataaaaaagaatactgcaaaacgcagcacaataattagataaaactagtggcatatgtcactaattaactatatagtcactaatactgtatatatagccaacacaggctacacaaaacacaaacgcaaaggaattaggaatgtaggtaggtacactgaggctaactgacacttctgggtcatggacaagcttgtttttagcacatcgtaaggaatgtaaccacgcttgaaaataacaacgatacatatcaaggtagttagagaggcattccagccatagatacgcaaccactttttcaatctgctatttgtattaacttgtaattcgcttgaattccagaatttattgacgaagtagacgaaaaggggtagttgcagaactagctcaaggactacaaaccagtatagccattctggtttctctgatagcaggaaatcgtgttgctttgcgatgtgatcactaacaaccttttgcgcaatccctagttgccatttagcggggataaccactgatgagtcgatgaatatggtgatgggaatgtgaacgatgaagtaccacaagtagaattgttgctcacgatgtcctagcttcattatctccggtcgcttttctctatatgttttcacgtgagtggctcgtttctcgtacttatttgctgcggttgttccttttatacctactaattcgtatcctgtacaaaagccgataattctttactatgttttcaaagatttttttttttaaacgatatgcaaattattaattcttttgaatatttctatgtaatctaaactactttacaatatactatatggaatacgtggcgaagaaaataccattatctcacctccgcttctttctcatctctttcattttcttgtaatgtgccttcctaccgctcgtagatttctcctgaatttcgttgtatttacgcttgaaatacttattagaagcttcatcacccatgagtgtttccaaaatagtcgactttctttccttcctgttcatacgactactataaaactcactcttgtcttcaattatggtaccaatggcaaacctctctggcacctcccaacgttgcttcttataatgtctctttggatcaagagcagctctatgtttaatcagcaataaatctcgttgaacttcacgacgcatgttatcatctggctttggtaaggtaaaccagtcattatcgtttttgtcgctcttgttgggttttcttttatcttctgtctccacactaggcaagacgttcttcttcttcttcttgtttgctaaagcatcaaatccggtttctaacttaggaagctttttaaggttagtttcgatctcttgaaatttactttcaatttctacttcatcatcattattgcctatctgcaaaacatcctcttgttgaagagaaacttgttccttcgctgaattttttacttctagactggcactagcatctcttagttctccaaataagtcttccacactttgatccatgtttaatagctcctttctcacgtcctctttaattggaaaacttgacgtctcatcgcattttctatttcttttctatcttctgttttaatatgctgaaaaatttttaggccggcactaaccacgaattatgataaaagagaaggatgtttagagaaaaggtttccgtgtgaaagggggaattgcgttgttaactgacatagctgtcttcaatggaatcataacaatgaagttcgaagacctcttggcaaccaataaacaggtgcagtttgctcatgcagctactcaacattacaaaagtgtcaaaactccagatttcttggagaaagacccacatcacaaaaaatttcataacgcagatggcttgaatcaacaaggttcttcgaccccatctatagccaccgatgcaaataccgccccaactgcttccactcacacaaacaccacgacattcaaaagacacattgttgccgtagatgacatatcgaaaatgaactatgaaatgataaagaattctccagggaatgtaataacgaacgctaaccaagatgagatagatataagcaccctcaagacaaggttgtacaaggacaatctttacgctatgaatgacaactttttacaagctgtcaatgaccaaattgtaacattaaatgcagcggagcaggaccaagaaactgaggaccctgacttatcagatgatgaaaaaattgatatactgaccaaaatccaagagaacttgcttgaagagtaccaaaaactttcacagaaagaaagaaagtggtttatattgaaagaactactgttggatgcaaatgtagaactcgatttgttcagtaatcgtggcaggaaggcaagtcatccaatcgcattcggagcagtagccataccaacgaacgtcaatgcgaattcactagcatttaacagaaccaagagaagaaaaattaataagaacggccttttggaaaacattctttaagccaagattaacataagacaagtttgcaaaatccccaacttcacttccatatgcatattcatttaggtatatatcgtatatttgagaaaaattcatatatgaaacgttattaaaacatgaaaaatagaatgtgttatcgggcttaactatattctgccattcaatgcgtgtttcttgaccatctctcgcactacctctgacggtacatagaatgggttatgcttctttgtctttttcgtgtgctcatattgtctttggttctcgaactcaacctcctgggttaaatttatattaaagaacaagaaatcctctatgctatcattattatcttgagattccatctcaaatagttcagaaaatgcggtgttcccgaggtcatcgtattgcaatttttgtttgtctacctcattactcaaattgctattgggggtgcttttgatagcaccactacatttattatgaagcatatccattaactccgtcctgagttgttccgacgtgtgtcaacaaaaggatttactaagaatgttgtattttgagttttaaaaggacgtgcatatgcacatacatatatatacatatatgcgtatttatcgtcactccttgctgtttagaagctgcacatattatgcatctatcgcgatagtattgtgagttggggataaagatttaatcatttgtgcaacaaccgctttctactttaggcatagaattttgcgcatcccaccccttattaacaatcacatttttttttaatattaatgactccggtggtcgtgattgtaatcttgatgacaatcgcgatcatgatcacgttctttagcctcattatcgaacagtactggaggtgaataggcacaccgtttatctaaaagttccatgatcgtggattggtccctcaagatggaatcatacgtatctacaccaccgtatctactagtggtaaatctcaaaatatccccagtgttgccacggttcaaaacatcaatgtggtccagtaatagctcatacggattcgttcgtggacgaggcagtgctcctctatgaatattgaaccgatgtttaattttccacatctgagattctaattcagcatagtttcgacgtcttgcgtccaattctgattgcgtccttggtttaacttcgtaatataattgtctatgtaagtcttggtattctttggcgaacataaagtgatttgaccttaattgcaactccaagctgcttgtagtatatggtcttttcatatcatttgatttatccttactcgaccttttaatagaaaacctcctgatgaagtgtggcacagcaaccactccaaatttttctagaggctttgtgggctttgttgagcttcttttgtcaattccaaggcaagaaaagtcgtcttcatcagccaaatattcatcttcaaatgtatgtatcgtatcatcaggcaagtgtttatcatcgtagcctgtatctgctttagttggagattttactcgtttttgaccaccagatgtatttgcgtcgcaattgctaatgtattctgcacctaaatacaacttttctaagtccgctggtaaagctggatcattaacacccagtggacttgtcatcgtgaatcgttgtgttaaactaatgaaagaaccttcctttacatttttgtccactcggtttttgcctttatcttgatccttgttatcaccatcggtaaaatcttggccgctattaattcctgaagcaacattaataccaccaccaatcctgctgtccaacatcgacaaggcatgctcacacctcccaccatttattgatagcccacttagtgtcagtaacctcgtatagaatccatataggaaatttaaatttgaacacgaaacactatactttttggccaaaatgatgggctgatgcaaaagaatttgagcaggatattcaaatcggtggtagaaacaataaggctcaaacggtaaggataaatattccggatgttcgtttgccgtagagttgataagttgcagttttttacctttgcaatattctacgattttcccaaaattaatctcttcttcaccttgtgagtttactagcaaaaaccttgcaattttgcttccacattgtgcaaagcaaattccaagtaactctttcaccagatctttaaaaataatttctgtggatttgttttctaacattttctcataatcaaattgttcatagatgatagaaaggatgttaagtgagattttaggaataagcaattcccacattttcaatgccatttgttttgggtccaaaattaatttagatttcatccatttcgcaacggtcaatccaagaaggaacctgcgaacatttgaacccttaatcccttgcaattctaacgaagctgctttggtgttttccagaatggttggatttgcttcaaaattagcatcacaataagttaatcccaaagttattacacattggtcatcgttgaccaatgcatatgatccaagcgataactgtctgcattcaacctcacacgaaatggaaataacacacttgcacttccctccaaaataacttatggctatgggctccagttcgcaaccaaaatcagtgctaataagcacagtcgtattgtcattcgtgtaatcagacagcaatcgacaagttgtttcgaaagactgtaaggaaattgcagacactaacacaatgtcaattgaatacgtatttgcaccgttatgttttaatttgtggtgcagctctttgatatccttagtgaaaatgtttggcgtgtagaaattggcgcctagttttgtcgatttccaggcaactaactcgtcactagacacatattgcgagaccagtattataaaagagttgctcaaacttagtctccatcctagaaattgtgctgctggtgtttctccaactgtaaaaaaaaggaaatttaaatttacatttatatgttagtaaatttttgttcgaatgtctgttttcttaaacttctttgccatacctattaagcacgttaattggttttcttccataactaatgcgagttcttgccttcaaaaaaagaaagaaaggcttaggaatacaatttgaactagtatttgtatcgtgcgtctatgtgcttttgttaatatgaagcgtattattaactccattcattttacttttcattcaaattttgatagtataatatgcctttgtctgcccggaccctgaattactgacacaaaatgaagggatcagtggccctagaaaaaaaaaaaaaaataaacggcgcgcggagtaactatgattatgattatggttatgattattattacaactcactattctaagtctatatcgtaaataagggtcgtgtccgtagaattcccctgccagcctctgttgccacttgtgcttattataaatcttgaagtggggtcgaggtataagtttgatataataccaccgtgatggcccggcacgatgaggaacggcactttagaactctttgtagtcgaattcgaagcatctactgcaatttcaacgttgtacaatctgatattatcccgcgatgcacatagtaaatgcttgttattaggcatggctttaacacaagagacaggccctgaaatagaaggcagtttcaaattatggataggtttcgagggcatcttcaagtcaaactgctccacacaggcattcctcctccctgcatacacatgatcaccatctacaccccaacatgcggacaaacaccacggtgggatgcctgcacctctctccagagacaatgctggcgactgcgtcatgcgtcggtcccaaatatgcacggaaccgttcaaccctgaggtcataaaaacggattcatcatagactatgttcaaagattcttcagatatctgttctttgttctcttcaccattagaaccatcccccgtctcgacgggttcgttgtcagcatcttgcttttcgtcttcgtcttcatcaccaaacagagaatccatatcgtcatctgcattttcattctctttaccactgttgacgttaccggacacatccacggacgagtacagcggccgcatttccaaagatgacaattcagaccttgattttttaaactcattaactatgtcacccgtcttcaaatcccattccaaaagacgcttatcccaggaaccactcaaaaacctgtcctcttgaccgtttaatctcagtatgttaacgatttgggtatgtccattcctgcccttaaaatagtgcgcaatgctcccctccatgtagcgaacgccctgcatggtaatcccaccattctgtagcccgctcagtataaagaggcattcgctttggacttccaaagaatgaacggggctaactttgggctcgtaatctgtcttattagcggagagtttcatttctgattttttctgcgggatctcattttcccagtacgactgcaagatacccgcgttctgaatagactcagccaacgaatgcttctgcaggatagttagagaaagtttcccctcaagcgtgttcagcaagtcgtacttccttatgtatccatcgctaccgcccagaaacaggtacttgagacccctggacacggccaacgcattgacgtgcgtctggatgggtatggctgccgtggggtagatattgtacgaatccgcaatctgtgcggcatgcaacatgtgcttatagtactcataaacctctccattagcagaggcttcgtgtgtagaggaagatgcttccctggaccccactcctccatcaacatcgctcaatttcacatcctcggatccaatcttagtaacagcatcgccactatcgccagcaccgccagcagcagcagcagcagcagcagccttttgctcatcatgctggtgctcattcgtcggtgtagcagtcttatccattcttgcggcgtcgtcctcaccatcgtcgtcatcatcatagtcctcgtcatcatcatcgtcctcatcatcatcatcgtcatcctcttcatcttcaccaccgtcatcattcccctcgaggtcctgctttgagtcgttttccagcccactcagcatctcttcgtcatcctcctcgtcatccaccacctggttgttaattagaatatcgtcaacctcgtccattacgtaaaagaagaaaaaaaaaaactgagcctttagtacactacagttactgctacagccttttacagcccagcatctggcaccactacgctataatatatgatgcgtctattatgctagaatccttcctgaaagggcattctggaagccctacgtacagagtgacaatatattagggcatccataaaaatggattagggcagctctgccatttttttcatagccgaaagaagaaaaactgaaaaaaaaaatgatacgaaaaaaccgcgaaacgacgccttttgttgcgattgtcgggcatcgcaagttacgacgcgttgtcccttgcatcgctgccgtgtggcacgacccactgcggcctaaacgaccgagatcggtgcccggggcagaccacccgaaaactcccgggcattatttcggtcgtttagttgcgccccagggcaaccggggtgtatacgaggccgatggctgcgataaacgaaaaattcaggctcgtataagtggcacaatagaaggtgaagaagaacagcaggtgcattgaaacaagaggttcagcagcgatcgggtattgttgttgctgctattatgtaacggtcgaaagaaacatcgcggtatatattagaggcggatttctatctttcttatcaattcgttttttcattcacttgttcattcattctttacatttgtcttgttctttgaagtggtggcagaggaggtcagtttgttgcatttgtaaaaaaagataataagaaaaatattcgtctagatttgagatatggatttggtcttagaagtcgctgaccattatgtcttagacgacttgtacgctaaagttctgcccgcttcgttggcagccaatattcctgtcaagtggcagaaattgctagggttgaacagtgggttcagcaattctacgattttgcaggagactttgaactccaagaatgccgtcaaagaatgtagaaggttctacgggcaggtgccattcctgtttgatatgtcgacgacgtcttttgcatcgctattgcctcgttccagcatcttgagagaattcctctcactatgggttattgttacgatctttggtttactactttacttattcacggctagtctcagctacgtgtttgtgtttgacaagtcgattttcaaccatcctcgttacttgaaaaaccaaatggcaatggaaatcaagttggcagtcagtgctatcccatggatgtcgatgttgaccgctccatggtttgttatggaattgaacggccattctaaactatacatgaagattgattatgaaaaccacggtgtaaggaagctcattatcgagtacttcactttcatctttttcactgattgcggtgtgtatttagcgcacagatggttgcattggccaagggtctaccgtgctctgcacaagcctcatcacaagtggctggtctgcacacctttcgcatctcattctttccatcctgtagacgggtttttgcaatccatctcgtaccacatctacccattgattctgccgttacacaaggtttcttatttgattctgttcacttttgttaacttttggactgttatgattcatgacggtcaatacctatcaaacaatcctgccgtcaacggtactgcctgccacacggttcaccatctatatttcaactacaactacggtcaattcaccactttgtgggacagactagggggttcttaccgtagaccagatgactcattgtttgatcctaagttaagagatgctaaggagacctgggacgctcaagttaaggaagttgaacatttcatcaaggaggtcgaaggtgatgataatgatagaatctatgaaaacgacccaaataccaagaagaacaactgaatacggttgccttgtttgtctcatcttttttctttctttcacgttcaagaactttcacacaacgaataacgtttatatatttatatacacatacatgttttaagatacgcatatcattatgatgtacacctcacgttagtgcaatatgcgctattcgtatattaaatttttgcgtccatttaatggctctttttcctattctagtgaaaaaaaaaaacagaaaatcgaagagctggaaaatttaagaacaggcaaataggaagctggaagctttaaaatgcccaagatttcggtgaagcgcaagtgttaactagaaaaaggccgccactactctataagcaaaaccttatgtccatagcacgattagtatactctcttttcagaagagtacgatcggttctcttacttttcattaccatatcgctattgttttactatacgttccagaatgaaatcgatatcttgaattcgtacgctttaaacgactcactaccgtccataaacaactatgagcacaatacagaaggctcttcgaaactggatcctccagacctatcgtcaaccagttctgaccgaatagccaccgacaaggaaaatggcaacgttgcagtggatttgtcagatccagctacattgagagaaaaaaacaagtactttcccttgctgttaaagggatcgtctcaccagatcggttcgaatttaccaatttcgtctcttttgacatataaggaaaagtatcccgtcttgttcgaatactcatcaccttccttaacttctacaagccagaatgacgttcataagatacagccggcaatgcaattgccaccagatgttgatatgataaaacagataaaggacatcttcatgaaatcatggaaccaagagcagttgctgctgaaaagtaacctcagaagggaatctacttggcccatagatctaattgattctctagatacattgtatctatgtggcgagacgaaactttttcaagattctgttaatataatagaagattttgactttcgagtacctccgttagcaatggaagttattgatattcctgacatcactacccgtgtcctagaagggttactgtctgcatacgaattatctatggataaacgattacttaacaaagcaaaacatgttgcagatttcatattaagatcatttgatacccctaatagaattcctatattgaaatatttctggaaatctgatctgagaaatcgatttccagaccgcactgttccatcaggtcaattgactactatggcactcgcgtttatcagattgtcacagttaacccgtttaaataagtattttgatgctgttgaaagagttttcaccactatacgtcaatcatataacgaatttgatatggagtttatgctgcctgacgtcgttgatgcctctggttgccagttattaactcaagaggaaattgaaaatggtgcacacctaaagggatccagcatcatgaaaagtatcaatgaaaatttcaagttcgtacactgtcagcagttagggaaattcttaaatcctccaatagatgataatagcctccaagaacaatctcaataccaggcttatagaattaatgaaaaaacagtacccattctagaaaatctattcaaaatcaatgacctcttccaatcttcttatgatatcctggacggctcaagtaaaaatgctaatgctgcaacgatggaccccagtattggttcagaggtaggagcagtcgacgaaataattgagaaaagaaacttcaaagacggtactaaaaaagattcgacaaaaaacaccgtaggtgataaatcattaatagactcgcaaacgtttttaacaaattccatcagtaacatttttaaattcatgacttttcgacccatgttgcccaagcaaacggaaaacaaaaagtttaattttctgaattccattctaacaaaatctcaattcatgcccacgactaatgagctagatgtcacgataagaaaatcttacgatgtctcgttatactcatgcagacttggcggcattctaggtttaagttcacgtgttccccaccgaggcggtgtcaacacgaaatatattttaccatcgtcactattggaaatgagcgaaataataacacaaagttgttttatgctaatggaggagttcgacgggctgctccctcaaaaattcgagttggacccttgcactgatgagactaatgggaattgcgagtttaacggagaaactaaatcacgaatgattgccaacggcgaatatgaaacttttgaaaatgacctagatgtcgggatcaaagtttcgaattatgggaaaggtggaaatgaccagaaagctaagagaaatttactaagcaaagatggggtaacagagactcaaaacataaaaggtgatactgttggaagctcgaaatcgattactgaaatagacggcgacgaagtaacgcaaatacgtagagtttttacgcttggtaaggatatcaaaccgcatattacaacggacgataccatgggttctcagtggaaaaaccatccggactggccattttgggtcaacaaggtagaatccagaagattgttggattcgaatatcattgaatctatattttatatgtacagaatcagtggagaacaaaaatggagaagcatgggtaagcagtcttttggaatcttaatgcaagaattgatggaactaaacagcggtgccaaaggattgtggcaaataaaggaattttatgaaaacggtgaaaaagtgaacaatgatttacctagctattggttctccagaacattaaaatactatttgctactattcagcgatggtgacaaggtttccctggacaagcacatcttaactcaaggagggcacataatcaaaaagaaatgaagttaacgttagaaaaatcgtacgcacatacatacatacatataggtacatatatacataatgagaagaggagaaaatgaatacttatacagtaatgtttatttttttgggattaagtgtcgttgtggtgatttctttacacagccaatgggtattcgccagcccagtcgtaaatttcctttttccaggtgttcaaaacatcagagccttcgtcgaccttggctttgaagtcctttaatctacaagcatcctttggcaagctttgttgaacttgttgagcgaattctacagccttgttaatgtattgaacaattctgtggaaatcttcttcacccattcctctagtggtcatggctggagccccaatacggacaccacctggaaccaaagcagatttgtcacctggaatagagtttttgttcaaagcaatgttaatcttttcacaaatgtattcaacacgagcaccatcaacacccttttctctcaaggataccagaaccatgtgagaatcggtaccgttggaaactaatctgtagcccaagttcttaaattcactttccaaagccttagcattcttcaagacttgagtttggtattccttgaattctggagtggcagcttgcttcaaagcagtggccaaagcagcaatggtatggttgtgtggaccaccttggtgacctgggaaaacagagaagttaattgggttttccaagtcgtataggacttccttaccggtcttagggttgatagatctcacacctcttctgaagaaaatcatagcaccacgtggacctctcaaagacttgtgagtggtggtggtaacgatatcagcgtattcgaaaggagatgggatgacacctgcggcgatcaaacctgaaatgtgggccatgtctaccatcaagtaagcaccacatttgtcggcgatttctctcattctcttgtagtcaattaaacgacagtatgctgaagtaccagcaacaagaacctttggtctatataggatggcgttcttttctaaagtatcgtagtcgataataccggtttctgggttaactctgtatgggaaagattcgaagtatgtggaaacagcagaaatttttctgttttcagtagcgtaaccgtgagacaaatgaccaccatctggtaggtatagacccatcaatctttcatgaggcttcataatagcttgataaacttgcaagttagcaggagaaccagataaagtttggacgttaacaccccatttgtctggagtaacatggaaagcttttaaagctctttgttgacatagaatttccattctgtcaatgtgttcattaccaccgtagtaacgagcacctggataaccttcagaatatttgttggacaatggagttccaagggcatcgaaaacggaggttgaggtgaaattttcagaagcaatcaaatcgatggagtgcttttgtctttcaatttcatccttgataatggagtccacttcagggtcggtgtccaccaaatgagaggtgatcaacttatgatgagcgtcggatagagtgtaaggcatgttaaggaggattcggtttaagctgttatgctttgctatggggtagtatctttcgtaaaggttacactataagaaggaaagattactgaacgcaaactaagggaagcaagttctgcattatatataaaacaagatgaagaagactcatggttcggtctaagatgattatgaatttaaaaattatacagagtaaaaagcgaacatgagaaacccaagagatagagtcaaacctttatggtcaaagcaacctgaaagggtcatttctcaccaggagtcatgtttcgtgtgtgaaatatttgaaaaatttcacttcttttttcttttttttttctacattaaaaatcggtgcgttgtcttttcaaagatgaggtagatgaagatggtgactccggctgttcagatccgattgactcgaccgactctgtttcctgtggtggcttcaagtagttgtccatgtaccattgcaattgagctatgctctctttgatatcactataagcagtgtgggcagcttctttttttggattacgtgcttgtaaagcgggattgtgtctgcgggcaacttccatgatgctactgacgtcaactattctgtaaaagagatgatcaatgaccttgggaaactcgcggaccatgaacaagcggtccatatgtacactattgcctgccaagacgccaacgtttttgtctgggatgtagcgctggatgtactcgagcagctcatcttctacctgggccaaagtcttctcacttgccaaaactttggcggtgagaccgctattaccgtggtgctcaatacaccactcgttcattttgttcatcacctcgggaccataatggatgacgctctcataatgcgagtctccttggccatcggccgctttgacgggtgccaagtgtccatcggtgatgatgcagcagatctcgataattctgtcattcacgtggtctaaaccggtcatctcgcagtcgatccagaccaagggtttgaacagcttggttttaagttcgggtgtttgcgccattgattgcaggttttggatggttcgaggacgtaagtactgtgaaacggatcttctgtacagcgagaagaagtttgggcgagtgcgagctacgattcttgccggaaacaacaaccacttcatcttgatctcttctgtttatttgtgaaagctccttttctttttttttcattttctttgcaaatcgaaaagttcacactgattttttattagttcttttaagtgcccaacttgacaggaaaaagaaacaccccaaagggaataccagtgtatgtaaggcttgaattatacgtatgagcatgcgtttgatggttgtcgtcagagcaagtgctctgagagtgtcccagatgactacaacccttgtataaaagtacatcttcttgattatttatcacgacacacgaggtgaccgattattcagaatcggtaccaaaaaagaaagaaaattgaaggaaatgaaaaattttcaatgtatttctcgaaagcctggagttgatcaaatgttcaaaaaatagggcagaatagcataacacacatcaataacaccgagccagcatgcctaccgtctccgtgaacaagcagcaattatttgatcttctaggcaaaaactacacttcccaagagttcgacgaattatgttttgaattcggtatggaaatggacgaagacaccacagaagaggccttgaaaaccggagaggagccggaattgaagcttgatatcagtgccaatcgttacgatttgctttgtatcgaaggtatttcacagtcgctgaacgaatacttggaacgtaaagaaagacctgactataaattaagcaagccaaccactaagttgatcatcgacaaatcaacggagcaaattagaccttttgctaccgctgctgtattgagaaatatcaagcttaacgaaaaatcttacgcttcttttattgccttgcaagataaattacatgccaatctatgtagaaacagaagcttggttgccatgggtactcacgatttagattcaattgaaggtccattccattacagagctctaccaccaaaggacatcaagttcgtaccattgaatcaaacccaagagtttactggtgacaaattgatcgagttttataaatctccagaacagaaaaacaacatagggagatacgtccacattattgaggattctccagtctttccagttattatcgacagcaaagatcgtgtttgctctctgccaccattaatcaatagtgaacattcgaagatctctgtgaacacccgtaacattttgattgatataaccgccaccgataagaccaaagccgagatcgttttgaacatattaactacaatgttctcacgttattgtgacgaaccattcacggtcgagcctgtagaaattgtctctgaacacaatggccaatcccgtttggcgccaaacttcaacgatagaattatggatgtctccattaagtacatcaactcctgtcttggcctagatcaatccgctgatgaaattgctcattgtctaaagaagatgtcgttgcatgccgttcaatcaaaggaagacaaggacatcttgcacgttgacattccggtaactagacctgatattttgcacgcttgtgatataatggaagatgccgctgtcggttatggcttcaataatttgccaaagggtgagaaattatccaatgccaacttcattgccaaaccattaccaatcaacaaggtttctgatattttcagagttgcatcctctcaagccacgtgggttgaggttttaccattgaccttatgttcgcacgatgaaaactttaaatttctaagacaatccgacaatggtgatttagctgtcaaattggccaacccaaagactttggaataccaagttgttagaaccactttattacctggtatcttaaagacagtcaaggaaaacagaaaacattccttaccaatcaaagtctttgaaaccggtgacgttgtatttaaagacgacaaactagaaaggaaggcgtacaatgaacgtcactgggctgccatctacgtgggtaagaattctgggtttgaaatcattcaagggttattgggtaaaatcatgcaaacttttagaacagagtggattgcagactacggtgctgctgcttctggcagaggttactggattgaagaagacgattctgtgaaaacctacttcccaggtagaggtgccaaggtcatgttcagatccaaagaaggcgctgagccaaagcaaatcggccacttgggtgtcttgcatcctgaagtcatgatgaatttcgacgttccattcgctgcatcctttgtagaggttaatgccgaagtcttcctataatgtaatgttctaacaaaaatttttactaatttataaaacttatatagatagatagacacatatatatatctatatatagaaacacaactaaagtttaccatgttttatataatattactaccgctactgagtaaatgtttagcttgtacttaactttcaaagacagcttttttgaaaaacatcagtacatttaataatacatccatacatttatgttaatttgtttttcctttccacctcagtgcgcttctcttttgaaaaatcctcaacatgccacgcgaacaatcttaccgagagtttcctaaaatgtttcaaactatcatttagctgcatacaatatgtacattattaattgagattaacaactttacctctactttactgttatcaaattataaaccaccaaaacaacagattaagaaacaatggccccaaacgtatgatactttaaaaggaatccatgcccgattacgaagtctatgttttactgttattgtaatgattgattgtacgcgaataacaaggaagatagtaaaaccaaaaaaaaaataaaaatgtacgaaacgaagaagcgtctatgtgtttagttgcttttctgtattttaaaaattcactacttgaacattgaactctatatcgactcccttctttttatccgtttctgaatgtttttttgtttgagattgtcatatgtgattgttaatagcagtaggcaactttgtggtttcgggattgaaagaaaatcgtgaaatattcgttttttactaacattactgttctgaaaatttttactaattttcaatctttaatttttttgatatagacttccagaaagcaaaagattgccaagacctttaccgtcgatgtctcttctccaactgaaaacggtgtcttcgacccagcttcctacgctaagtacttgatcgaccacatcaaggtcgaaggtgctgtcggtaacttgggtaacgctgtcactgtcactgaagatggtaccgttgttactgttgtttccactgccaagttctctggtaagtacttgaagtacttgacaaagaagtacttgaagaagaaccaattgagagactggatcagatttgtctctaccaagaccaacgaatacagattggccttctaccaagtcactccagaagaagacgaagaagaagacgaagaataaattcattaatattattttaaatagagcataagttttgtataattaaaatcttctaaacctaataaatatgtttaatgaatgattcaatatcaaaaaaagaaatccattgggcccttaatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctctttctgaattagagtacatctcatcgcagggtctctttttgcacgtttttgatgttgcttatgagacgctttgcctttttaacttcttcagtatactttaaatatataccaatttattcacaatatcattactcttctcagtttccaattaacatgaatcctaaaaaagtggcccaattgcccgttcacaataaatcaacgcttccaccacaggaaataatcgatctttttaaaataacattcttagaagagctatatccaaaagatcaagacaatgaaaagtcaccgttaactgaacaaatacaggcggtaaaatctgacctttataacagagattacaatgctgctttcaataacgactcgaaaagaatagcatattgttgtcgttggtcaccgtccagagcaacaagttacgcatcagtatttgcacatttccctgagcttctaaagattatcagatgcgaaattgatgacaaggactcaaatgtgctatgcataggtggcggcgctggtggtgagctggttgcattagcgagcatattcactttatcgagagatttttcgtctaaatttgcctctgctttgaaaatagacaacgaagtaaacaaaaagcctagaaatttaaacatacaactagtagatatcgccgactggtccacagttgttgaaaagctaacagctacaataaagtcgaaatggctatatggtgattcagaagcagagtcatttaacgtcaactttacccacaaggactgcctacaaatgacagagccacaagatatcaagatatatcaaggtctcgacctaataactctactttttactacaaatgagctatttacacagaaaaaagtggagagtataaaatttctgcaacggttaaacgagaactgtgccccaggctgccatcttctcatactagagagtgcaggaagctattcccacattaccatcaacaacaagaagttcccaatccaatttcttatcgatactatcttagtaggcaatagaaaggacaagggaacgacaggtccatggtcactagtatccgagaacgacagtatttggtatagaatggacccaaaactcgactactcgattccattggaaaacatgcgattcttttaccgtctttatgtcaagaactaacaggctttatgacgttttactgttctcttttcattgttcttttctcgaagagtttagaaaaattttttttcttctcatccacaccgaaaaaatattaataagagagttgaaaattcgatttggaatcagaaataaagaaggggccacgatcaaacaagactcatttcgaataattgtaaaaaaaaaatagcacaaaacaatatgaccgttcccaggaatcgtcccatggcaccatttggcaccattatcaaatcaagaataaaacaaccccagttttattggtttataggccattttttaaccatctttaactttatacaatttcatctttcaatcacgtccaaacaaaaccaattgtcatgctatagaagatcattattttacatatccgttacatatgccatcgttctttaccagtttttcaaaagtgaccagttaaagttcaattttacgcttttgcgccaagagatgaagaaattggataatttgcagtattttgccatgctattcatactttttctcttatcacagtttaacatcataatcagcggctcgttatacagtcccgttatcttttcaatctttcacttcctgaactattttaaggaaaaccttttgccatttttgcctttgataccacttaatttgaaaaatttgttgaactccaaaataacggtattcatccaaaactacaatggatttttcttacagatggcgcaaatatttgagattatctgcggcctacgtgtgggcctcttcttagtgcccttcaattttttcttgttgttggtaagaagagcaaacgtgtcgtttgaggtagtgggtacaatgttggcagggctaacctatgtatggtttttcaaattaaggtacctacaaagtgaatctatgaggcagatatttaaacaatatgtccttaggttggatgcatatgtcagccgtactttgcccccatattgttcccgtttatggaacggctataagaatttcgttatgacagtgttttggaagatacctgtgtagcacgctcattttaagtatatctaaatattattttgtatatactcacactcctctatagaaagcaaaaaatttcaaaaacgtttgaaaagctttgtttaacgatacttgtacttaattttagagtcagtttcacccctcctctcccttttcatctgccttttggatttggattgtccttcattagcattttttgagcgattatctgcctgagtttgttgagcgccaggcatgaacatgtttttgaggccatataacttgtaaccagcatagatggggcacaatagtagacaccaccaaaacttgaatgtcctgaaagctataataccaatgttaccaaaaagtgatagatagatcaaatcaaaaaaatatgatatcaaatttgtattgtcgttcaagtctataccttgttttactacgcgattgccatcatatttgggcttaccggatagcacaatgatatacagagcaacgaacataggaacgttcaaagccaccagcttaatccattggccaattgtaaccttacgtgaaatgaatagacgtacgatagccattcctaaaaacaaagagacttgcttgtataagccctgaattatttttgcatttgaactagcctgtttcttccctgctttgccagccattctaccaacacaaacttagaccactgcctttggtgtcttcttgaagccacacgtaaatactacctttttttcatctattatctttttttaattacgttgaaatttttcatttcaaaggcgcagaacgaaggtcgactaatttcatgacagtcggtagacgtggagaaaaaagttgattgttaagcctattaagttccattgagacaaagacccacaaagctagctagcattgccgcacttctccagaacaatgttctcctttgtccaaagattccagaatgtatcgaaccaggccttttcaatgggaattgtaatggttgtattcatcatggcatcctcatactatcaattaatcaataataacgcgttctcagtacctagtaatatcgataacgtcaaaactttaataaatgttagaacaagtagatattttggctcacagagaggcaaggcaaaggaaaatatgaaaattaaatttgatctaaatacagatctcactcccctgttcaattggaatacaaagcaagtttttgtctatctaactgctgagtataacagtactgaaaaaataacaagtgaggtaacattttgggataagatcataaaaagcaaggatgatgctgtgattgatgtgaacgatctaagatccaagtattctatctgggatattgaagatggaaaattcgaaggcaaggatttggttttcaagttacactggaatgttcaaccatgggtaggtttgctaacttacggtgaaactgtaggcaactatacactgaccgtggaaaataaaaacaaagtttagactagtctttgctctctcaatttttgttaattatttacatgattttttgatatatatgcagttgattatacaatatgatatatgcatttctagaatttactcacaggtaatactctcttagatttcctcagttctttaaaatatgaaagatgtctcatttcaatctgttcccatttattgatcttgcttcttggcattaataagtaatctttcataaaatacttgtaatttgatatgaagtcacgtacctgatcttctaaagtttttaaatcatcaataccgtccaaatatgtgtctaattgcctcattatactgttatatgtatcgctttttaagtatagtctgggctgaaatttattgggctctttttccttcatttttaatgttggccaagatttatcactggactgcgtcttatcctcggatagtttcgttaatagtctaaatttatggatcagattatacccatgaattagtgtgtcatcaacgattttcataccatacgaaagggttcttggatccttaaatagcgcttctacagcgctgttccacgatatattatctaaaataaaacctttttctcgcaatttcttccacagtaatggcagctcatcgattttattcattgcaatcaactgacttactttataagggaacaatccgctgaatatgcttcttagtttaatatttggcgttgtagatgatggcaagttttcaatgttttcaatacgatccatgtatttagcgaaaagtgtttcgaaatctttccattgttcaatttgagctagtaataccaacaatgatctcatcatcacaaatttattattatttgatatccaatcatgctttttgaagaaaagctcattgtaccggttgtataactctaaagcccgctgtgggctatcatgtttcacaatcattctcattggccatgccatgaccgagggatgcagtttgttatacgtaacgtcgagagttccattggcagcattttccatgatgtcttctaccatattaatcgtttccttgatttcctcattattttgtaggctttttttggcaacggccttcaatatataatataaaattttggaattcgctggtaccttattttgtgacattgtcttgtacaagttaattataccgtcacgataaccctctttgtcatatgcctccattattatttcaaaatgtgtagcgtccaccttgattacagaatgttttattagttgatctatgatgctcaatgccgtttcgcaatcttcgttcagtgtaactaaaaattttatcatcatcttgtaaaattcactgttaacagccagttttgaggttgtgatcttgtcgaaaagttcttcacacttgttggcatttcgtaaaccaatataagctttgatggctttgttatacacggaaattagaccatctctccaagataaattctttgaatgtttttcaaataatgctattgcctctgttggcctgttactctcaatatatacatccatcaatgcagagatactttttccagtgtgttggatattataatgttcagtcataaggttgaataattcttgagcgattaaatggttcgtagttttgcaacacatttgtatcaataaagcaaaatgcccctctgtgatttccacgctaggatcctcgcttagtctttttaatatcctaaacgcaccatcaaggtcatttaaaccacgatacactttaagcattatggtatgcgttgctgttgaaggctttatgtcgtatttcttgaatagttcgaagtggctaaaacaggctgcgaaatctccgactttataatgtgcatatagtaaagattgtaaaacggcgtatgtcggtatcatacctctcctcaataactgtgtatatagtttattgacactatccaattcaccaattctggccatagtatacatcaaaataccataatgttgtatggaaggtagcttaccgataccgaaaagagcattgaactgttgttgtaaggcgtcccaattatgcagcctagaatgagccaccaaaagataatcaaattggttttggtcgtgctgagcatcagggtatttccaatatgttgacgaaaccaaattaaacttctgcctgtgacaatacgtctttagaatacacgtcaggtcagaactcactatcggcaggttatgttcgcacttgtaattccaaactgcttctgcagaagaaaatttcctaatataagttaataagaacaacaacgtagttgcaaattgagacgctattgcgggcccttgcgttagctgaattgctttcaaataagataaataatcggggcgaacatttgattgcctcatgaatgataaaaagtttctcaaaactatcttgttctccatataattcgtaaattcacaatgtccattcactagtttcatccatttgacccatttatatacagcttcttcatgcatattcattataaccatcctagagaaaatcgagttaatgaggtctatcaccattgtcttttgtgttaatagaaaccgttgtatgatatcagagattgcctgatctaattgaatacctctttgtaaaatcaataaagagagaaggaactttttcaattcaggtaatgaggcatcctgttttaacaatctttgtgaaccaatagtggtataaagaaactcctgtgcaatttttataacgttcccataggcctggtgccgataaagatactttataaggtactgtcgttcaaatgttgtggtagctgaattacttgttattgatgttgttgctttctttgttaatccactgccaaccgactttagaggaacacttccgcgcgccataaaatatgagaccaggtttctctcatcctgtgagcataatggtgacgtcgatttatctcgaagcagcttccttatatgatcaggtacgccggtactccatatacccttcttataattataatttcttaatacggcaggagcacaccttttcataatggccaaaaagcgtgtttcagtatactccaacacccttaatcacttaaattcgaagctttgtacactattgcggcctctttcctgggtatcgaggctgcgttagcgtcacctagaaatcccactttaacttacactacatgattttttatttttatttctctattggcccgaaaagttacttttccttcaaacaatgaaaaatttcaaaatcaaacctcatcgcgatagtattaaaagtgctttcacaagaatgatacaggaaggtggtcaagtaagcaactaagcaaaatcaatatgggtacagccaagcaaaatcaaaatagaaagaagtttacgagggagtataaggttaaggagatccaaagaagtattacaaagaaaactagactgagaaaggaataccttaaagctttaaaagatgaagggtatgccgtaccagaaaaggaaccaaaaaccgtggcaaaagaatctgtaaggaagattaaggaagccagggcaatagagggaaagaagaaactagacgagaagaaggagatcaagaaacaaagaaagagaatgcaaaaagatgaattaaacaagcaaagaaacgagcaattggaaagaatcagagtttcgaaggaaaaatttcagaggagagaagatagaaagaagaaattgactcaaagaacaaggacaggccagcccttgatgggccctaagatagaggatcttttggataaaattaagacggatgatacttatacctcctagataatgatattcttcaaaatttcttttcattcgtgtatttacagaaagatctttttatttaaatttacttaattagtgtgtatattaattttatttcctgccttttgttaattcctttttattggaatttgttatttacaagactgttttgcccatgaggacttgactatttcttcgcttgcttcttttggaactcagatatcaattctttttgaacatggggcgctgttggagcgtaatgactaaactctaatgaaaactcacctttaccttgagtcgaggctcttaatgaggtggcgaaaccgaacatcgtgctcaaggcacattctgcttttaatgtaaattcatcatgaccattttcggtatcctgtattactgcttgtaatttattcaataaaccgatgacgttaccttgaaactcgtttggcgatgttactgaaacattcatgataggttccatgatcaccggctgtgccctcaggaaggcgtcacggaaggctgacatagtagctgttttgaatgataattcattagaatccacggcatgaatagcaccatcattgattagcattttaacatccaaaacacgatgaccgatcaatggtcccttttcacatacttcttcaaaacccttaccacatgcagccaaatacttgtccggtatacggccaccaacaatagcggtctcgaatatgttgcctttggtaatgtcatccacgggagataaggtaccgataactctaccatattgaccagcgccaccagattgttttttatgtgtataatcaaaatctgccgggatggtgatagattctctataggaaacctgcggtttacccgtgacacagtccacattatattcacgtctcattctttcaacgtaaatctccagatgcaattcacccatcccagaaataattgtttctttagattcaggatcgaacttcactctgaatgtagggtcttccttttgaaatctgttcaaagccttcgaaaaattcgatgcgtcctttgaatttggcgtaatcgataacgagacaacagcatctggaacatacatggatgacatagagtattgaacgctaccatcagtgaatgtatctccagaagcacagtcaataccaaaagtagcgcaaatttcacctgagccaacttcatcaacatcttccatctcactagaatgcatcctgaccaatcttgcaaccttcacttttttaccagtctttacatttgtaatgtaattaccttttcttaaacgcccctgatatacgcgaacataagtcaattgaccatatttgccttcttccaatttgaatgccaatccaacaaatggctgttgcaccgcaggaactaagttaaccttggcttcgttgttgctcacatctagagctgtattcaacacttcagagggattaggtaagtagtctacaatagcgtccaaaacgggctgaataccagtatttgccagtgcggatcccatcaaaactggtgtaaaagacctagcaattgtagatctgcgaatagcatctttaatttgttgcgtggtaggctccttttcttccaaaaacatttctgccatttcatcatccacatcagcaagtgtttcgatcaaaagttgtcttttttcctccattaatggcttcaaattttcaggcactggccctttttctataatttcaccattatcacccttgttgtaaatagcaactctattaatcaaatcaacgacaccagataagcttgattccgatccgataggaatttgtacagcagcagcaggtatttttagtttcgaattaagttgttctattgcacggaagggatctgaacccatacgatccattttgttgatgaaagttactcttggaacattatatctacgcatttgacgatccacggtcacagtttgggattgaacacctgaaacagcacaaacaacaagaactgcaccgtctagtactctaagagcacgctccacttcgatagtgaaatcaatatgacctggagtgtcgatcaagttgaaatgatagtttttgccctctttatcccaagagcagtaagtagcggcagactgaatagtaatacccttttccctttcaagatccatagaatccatcttggctccaacattatccctaccacgaacctcatgaatggctttgattctttttgtatagtacagaacacgttcagtgaaagtagtttttccggagtcaatatgagcagatatacctatgttacgcaatttattacatctttcaatatcgtctggagtaagtttttgtttgatttcatccaccaaaactttttcttcttcatatgtagaacgagcaagtggactctcatgaaaagaccttctcgagaaacctgaaaaaacttttgaacatgtgaaaaagggtattctacctccaaccatttttcgaggcacccacatcattttctggacactcatattggtgatatattgcagtgctttctaccttcttccgtttcaatctcctttattaaatctcgttttttagatattttcatcttggaaatttcggccgcttgtgaagttccatccccacaataatagtgcaaagttatcatattaatatatatatatataaaagacatataaaaaaaatcaaacgtattgtgcatcttgggtgccaaaagttacattttctttccttcattccgggccctcaatgatcgtcttgatattatttaacgggtggtggcttgtttcttcgaatgcctcgacagcatccttaaagctatagcgatgtgtaatgaatggtttaagcgagagttttctgctagagactagctcgatggagtcactataatcaccttgacagtatcggaaacagccttggaatgtcagttcttttgttggaatgatcgagatgggaaattgtatttcctcttgtcccattccaacttgaacgatcgttccacctgccttacagacttcgatgcctgctcgaacgcaaggctctgcaccagaacattcaaacacaacgtcagcacctttcttgccgattgctttttttataacactatctacagtaacgccatgtgggagatcacctgagttgacgatgtgggtggcaccaaactgcctagccctttccagcttgttttctaatagatctacaaaaacaacatctgcagcaccaaagacactggctactttcccggctagcaaacctatgggcccagctccaaagacgacgcaacgggctccaaacttgatctttgctaatttattagcatggattgccactgataatggctctattagtgctccttcctcgaatgacacatcatcaggaagtttatagacgaaatctttcatggtcttataatactttgtcaaggtcccatcaaagggaggtgtcgcagcaaattttaaattggggtccaggttgtatctgccctctttcatctccggtgaaaacctgtcaggtattccgggctcaagtgccaccctatctcctactttaagtgtcttgatgttctcacctatgagggccactattcctgatgattcatgtcctagcaccattggtgattctaccacgtaattggctattcttccatggatatagtaatggatatctgacccgcatattcctgtcgccttgatctggatgattacttcgttaggatcggaaatctttgggatgctgacattagttagggtgattttaccaggtcgctctagaacaatagcttcttgtgtagttaagtcagtcatgctcaatggtgttctctatcctcaaggcagtatgaatatgtctttttagtgtgtatggatatatttatgtatatatttatacagttttcaattttattttgaattaattcaggagaggggttacaatctcctaagggatagtagcgccggtgacattttattcgctctaagatgaacttgagttcgagtccactttgaggatattatggatttccattaggataggctctatctcactgggatcgcaagccacgccattgcccaaacgaatggcatgtgatgcgtttgcgggtttgacagattctggggtacctaatctcttagtatccagcataaatacttgatttctcacttgatgcatcattggataggcgggagatttcgtggttatgtgtgctacgtctgcaaaatgaatgtgaaattgaattttatcacggccgttatgcaaaacagttttcaattctatacatattgtaatcttagtgcctgcctgagggttataatatactatctgatactcgtttagattatgcaacccaatgttcaccatagtggagtactgacttccactctcatggaatttgccccctctttcattgagaattacttttagagctttaaacaaggatgacgtgaattgtaggtagctaaaaataaaatgataatccattttcgaattatctaagaaaggttgaattatatgttgtgggtttgaaggtgatagttgaactgtcagatttttaatagagtcgtcattcgttgatatctttattgtgcagtctttatcatcttcgtcattattggagagatacttgaaagaaatttcattcggttgtaatgcaattatcttgaagttttcggactcaaaattcttgtgcaatctttccacgacatccgttagtacaaccaattgcatcaatttttgcctaaatttggttagatattgcactattataccaagatttgtaaaactctcctccaaataaaaggctaacggttcttcttgtacaaagtgaatgtatagtttatcaatctggcattgaatcatcattgtgtttcttttaaatttagcatacaatcgtatttgggaattggagtaatctatcctcagaaacatggaactttctaatatggagttcagcgcttttgaaccttccaaaaatgactccaattctagagttattattgatatgttatcattagtattacttccttggataatatattgaggtagtttttgctcgttgatcatttcagaagaacaaatcttattgcgaatttctagttggttcaaagaatcgatcaacatatggtttataattctgtttaaaatagttctttgcaatatcataattttttgatatgttattgactccaatttgacagtcatcacgttggaattgtctaaatatttgagattccatttcccacgttgagagacaattttaccgattcttttttccaccacacatgatgttttagaggatattatcgataaaatcaaataccagttgagcggccaatgtggtagtctgataaataggtccctttgtaataacaaggaaacatcactattagtagtgttgttaccagcaatagcatatttattatcttcttttttaacaacgctttcgccgccagtattcacttgagttctgattggtttatcaatcttaataatcctgctgcatgaccatcccgtgttttcaaacatggtggttaaaacatgaataatcttgtccagtttcagctgctgtagtattcttgccaattcctctggaccttcagctctatttatctttgacgcgtaatttgataatagtggagtaggattcctaaaataaaactgcccgctcaataaatcaatttttaattgaataggtgccatggaaacacatgtggtagggagttgaaataatagaacatccgaattttcttcgtcttcttggaatatatcccttgccaacagctccgatctgatgattctagcatgattgaacataatttcatccaaaatcccttcgatattagatacaatattgttataaattacaggcatatttttggcccttgatgcactctggttgtcccatttcaagataagactttctgttgttctttgaatgccaatagtgatcttacccttactgtccattttcccattcagccaatatctaactgtaattgtactttttttagagtcatagttatggatcaaattacttttggaaaatttaccgccgttggccagctttaaaaactctctatgaaccatgtatagctgtaatgtcaacacgtatttgtgcagaaaattgtatagggataataatggatcattacttttcaaaagaatttcattgattaacttctctaatcttggcttattcaaaggaaggttatttccgttggaacttgagttttcttcattgttctcactatcaccgttagtcgaagtagcttctgtaactgctgaaacggtttgttcagcttccgtgttaaacaacaattttaaatccacaaaaaacagaggggactgtctattaacagtcgataactggatttcaaattcattagggacagtaaagtagattctaccgtttttgatatgatagctgtttaatggtttaggaatgttcattaatgcaatttttattgagacagtcaagttcaaatcttttaatctctgtaaaatcaatccaatgggaactttggccattccatctaccatatccatagagttactgacaccacttaatttaaagttgtgtgtaggtagatttggcctcccaagactcaaaacttccaaagcggtgaccaaatccacgttgggcaatttagcattggtcatagagtttagactgcttttcaaagcccaaatacaattgttgacattcatgttagtcgttctaaaccagttcaacagatcgattagtacgtgaaagttgttttgttttatagtacgggtccatttcacaagcacgtaaagtttcaaaaattgtgtccttaggaatataatcagctgtaagaaacgtattttctttgcggagttaggctcatttgcctgggtgtgaacattagttttcatgtactgagcaagttccttcattgtaaataccgtcaagttccttattactaatgccagactgacttgattaatctcaacatgcggcaacgctggcggaggcgcacttgtcatagtcgctgcacttgtatctttcggtaccatttctagagattctttttgggtggccgtagtttccgggacggttgcagaagggctatgcagttgagtgttcttaacgggaccctgttgcttttgcccattctgctcggagcggttcttcagtgcgtgcatctcgttagaaagtctctcctcattagccagcatttgtggggatcctatcgtggtagtcattgcccagccaagaaaaccctatactttcctgctactttttaactctctttctgatgatctttacaacagacctctactaaacaattgaaaaattcaccgtttttacttgaaccagcgaccgtgcgatgggacaatcgtttagttaacaataagcgggacaaagtaattaaatttagtggcatctagagagaataatcgaacgcaatgaagagagcatgatacgttgaattgtaggatgtggggggatagtatgcgcgagcttggtgacgctatggataatgagttgaatgcagtgaagccggtggtggaagaaggtggcatggatggtgccagaaaatttattaagggtaagagctttcagaagtcttctaccgaacatatgttgatttcgcccggtagggatggttcagtgccattgaatgggttgaaatcgtcgccggcagacccgcacttgtctgatgttaattctatcttggacaatcatcgtggcggtggcgagacagctttgacgtctgtaaataatattatcatggccacttcgacgaatggggacagtgatggcgttgatggagatgccaagaggccgtctatttctaactgttcgtcgagatcatcattttttgacaccgtactgagcacgttttccctaaaatcaaattcacaagatacggttactaatgaagtcaaaaatattgaggtccagtttgcatccgaggaggctaataaaaaattccgccaaatgttcaagccattagctcctaatacgagacttattatggactacttctgctacttccacagagaattcccctatcagggcagaatctatctctccaacacacatttatgtttcaactcaaccgtgttgaactggatggcaaaattacagattcccttgaatgaaatcaaatatttagataaggtcaccacaaattcaagtgctatttcggtggaaaccgtgactaacaggtacactttttccggattcatagcgagagacgaggttttccaattgattacaagagtttggtcaaaggaaaacttaaccaatatcaatgacgttttggaggttgatgagagggtctccaagaaaaagggaatatcatcgaccccttcttccatattcaacaatgtttctaccaatgcatataacgatttcatatcgacaaccactactgaaccaacaagcagggcttcctacatgagcgagaacgacatgctcatcgaggaggccataaggtccgtggacgattacatgggcacaccaagagcatcgccatcttcttcatcttcgtcgtcatcgtcgtcatcgtctttaggctcttcaacaacttattattgtaggcccgtatataggttaaagccaaacgcaccatttcaatatgaggggccattccatgtacaagaaaccatggactttccttataaacctgaggctaataatgaatacgtgcttctggaacgtcaattcagcgttccacccggcctacttttcattatgatgttcaatgaagataatccagtttttgagttaagctttttgaaaactcaagattcgtccaacatctcacacatagggacttttgaaaaagtcaataaagatggacaacattacagagaattccaatacaccaaacagctgcatttccctgtggggcccaaatccacaaactgtgaggtagcggaaattcttttacactgcgactgggaaaggtacataaatgttttaagtataacaagaacaccaaatgttcctagtggtaccagtttcagcaccagaacgagatacatgttccgatgggatgaccaggggcaaggttgcatattaaaaataagtttttgggtggactggaacgcatccagttggatcaagccaatggtagagagcaattgtaaaaatggacaaattagcgccactaaggacttggtaaagttagtcgaagaatttgtagagaaatacgtggaattgagcaaagaaaaagcagatacactcaagccgttgcccagtgttacatcttttggatcacctaggaaagtggcagcaccggagctgacgatggtacagccggagtcgaaaccagaagctgaggcggaaatctcagaaataggcagcgacagatggaggtttaactgggtgaacataataatcttggtgctcttggtgttaaatctgctgtatttaatgaagttgaacaagaagatggataagctgacgaacctcatgacccacaaggacgaagttgtagcgcacgcgactctattggacataccagccaaagtacaatggtcaagaccaagaaggggagacgtgttgtaacagagtaatcatgtaatattgtatgtaaggttatgtatgttcgtatggtataggaaaaaaaaaaaaaaaggatgctatgtggagaatgtaaggcgtggtagctccggataattcagtctgtaggcttcatcacgggcagtggcctgactctgagagcttgctccggtattaagttgtgcgtttgaaattttctggaaaaaagaaattgattggttgaagctatactcgtcgaaagatttcttcggcagtggttgttgctccacctgcacgggagttgtgtttgcgtttatgttcggcttggctatattattagcgagtgatgtttgcaatttgctgtattgagagtcaatttgggtgcgtaagctttcaataattttgcagaccgcaggcacttccaactttatgagttgcaggtattctcttttatgaatatacgatgacgacgatgacgacgacgcatccatgcgcaaaagctcagggtgtctagatagtttgttagtcaataaatccacatatctaaaataataaataaacgacagcgacaagtcgttggcctggaacgcacactgtgccttttccaatatgccgatgcatgttttcaggtaaattctcaatggtatcgccggattgaagcgataatccttagcgtcctgaaccaattgcttactagacttcatgacctaccggggccagataaagatgcggaaggaagagaaaaaatgtatagtggttagtgaaccgcaacaataattcgtgccaacactttaatcgaagcaaaaattgtcttgtatgttattaatattatctatctaaccattgatttacgtataaaactgtcgatgctcatcgcctagcaatgaaaaatttttttttttttctattatttctctttgttgcgtactttttttcattgcgtttcgcggcnnnnnnnnnnnnnnnnnnnnnnnnnnnnnnnnnnnnnnnnnnnnnnnnntgtatatgcctatttttggttctgatctttactttactgttaagtactggctgaggcagtagactctgcctctgttacggcagcggtattcgcctcggcatcagcagccgcccacggtagagtaggttctgttgttttgacgtttgccaaggtactgtccaaatgctccttcagcaaggcctcattactttccttctccggacccaccgattgcgtgatctcctgtacacggttcaagaacttgttcaaattgtagcccgcagcagcatcagagacttcttgtgtgtaagggacacccttcaactccttgactcttcttttgtgcactttgccctttaaatgcgtttttaacgctatagcagtctccatgtatttggcacagtgtatgcaatagtgctgaccaaggcctggtttggtttcatccaatggctggttcagaagcttctgtactgattccttggtggacaagtcgttatagatcaggtccaagtctcgtgttcttcttttagtcttgtatctcttcaccgaatatctacccatgatgcgctattgttttatcttcacttgtctgtgtgtttaactgcctttcaattcacctcatctcatctcccgctactttccatatataaaagcaaaattaatttgctttttcccctgtcagtataaaaaaattttccgcaggatatagaaaaaaaagaaatgaaattatagtagcggttatttccgtggggtgcttttttacacctgtacatcttttccctccgtacattctttttttttttggttttttttttttcgatatttttccctccgaaactaattagcacaataatgctgactaaggaaacttttcatctcagaattgatggtcagtttggtttctctagagaatagtttataaaaagatgttgatgtggagcaaccatttatacatcctttccgcaagtgcttttggagtgggacttttaaactttaaagtacagtatatcaaataactaattcaagatggctagaagaccagctagatgttacagataccaaaagaacaagccttacccaaagtctagatacaacagagctgttccagactccaagatcagaatctacgatttgggtaagaagaaggctaccgtcgatgaattcccattgtgtgtccatttggtttccaacgaattggaacaattgtcttctgaagctttggaagctgctcgtatctgtgccaacaagtacatgactactgtctccggtagagatgctttccacttaagagtcagagtccatcctttccatgtcttgagaatcaacaagatgttgtcttgtgccggtgcggatagattgcaacaaggtatgagaggtgcttggggtaagccacacggtttggccgctcgtgtcgacattggtcaaattatcttctctgtcagaaccaaggacagcaacaaggatgttgtcgttgaaggtttgagaagagccagatacaagttcccaggtcaacaaaagattattttgtctaagaagtggggtttcaccaacttggacagaccagaatacttgaagaagagagaagctggtgaagtcaaggacgacggtgctttcgttaagttcttgtccaagaagggttctttggaaaacaacatcagagaattcccagaatactttgctgctcaagcttaagttcttttcaaacatttgaactaacttaaaagagaaatttttttgatttaaattctagtttattaaacagtaaatatatttatacattattgtaatacatataattatgtgtttttttaaagttcaacatgttgggtagtgatatatcctgaagtcaatggacactgttgctttttgtataccagcaggaaaaaaaaaagcctgagctgcagtaacgaagaattgttgaatgcgtctaacaagaaagggagcaatcgataacagggacgtgcgccgctaatgtcattcagattattcacgaggacttctcaacgtctccctcgccttaactgggttagtcccatcaggcgatacgccaaacaacctcaatacgatgaagcagagttgtttgcagagaacattaaccatggcgcatataaagcaaagaaaaggccatcagacgagcatttccaatggcctgagaagtctcctgatcagatcacaaaggaatctgaactccaatgggaaaggatggcaaaattatctgctgttggacaagggatcctcattctcgtggtagtgggtgggttgggaacggcctacttgcgttggccagaattaaaatcctggtggttaatcaagatgaatggcggtcgcataaatgcaacgcaagagcaaagtggacaggattcgttggagaaattgatcagacaaaaggccaaaaatctattaagggagattcctcaagtgcctgcctttcaacttggaatagatcatcctggtgtatacatatggggaaggtgtcattctaaggactcattgttccctgtcagagtacctaatttggatggttgtaaattcagagatatcctattagctccctctgacgatttcaacaccaattttgcaattgacgagaaaggcgatttgatatcgtgggatgatttgggacaaacaaaaacgatattgccagatcaagatttgacctcaatgaagtattctagtcactttttgtacgctttaaataaaaagggtgaaatattggtcatacctattagaacgccggatctgatagcttcgcaagtatcatcaagaaggtcgaaattgttgccatggaagacaaaactaagatatgattggaaattacaaacaaatcagattttcaacggtaaggaaggagaaaaacgtgtaatacaatttgacgccggtagccatcatctggtgttgctatctaatttaggcaaggcttattgctgcgcgacgggaaatgatcaaaaacaagctcaagtatccaaaggacaattcggtataccaacattctcacaattcgatgagtttcctcccaataatcaactattcgaaattgaactgctgaacaaatttaagcatgaaggagaagacgttgttcgcaaaagagaaattaaaaagatagcttgcgggtcgtaccatacactggcaatagataagactggtgaaatttatgcctttggctggaataggttcggccaattggcactacctatttcgtacaatctagaatatgtttctttcccaagatcggtaacgtatgcatttaaaccgcatttcccggggatgacgaattggaaatgtgtggatattcattgtgatgatgaaacatcgtttgtgaccattcgtaagcctggctcaacgtcagaccatcattatttcgcgtttggtaatggactttttggtgaattgggcaacaacactttcaagaactcgcaatgtgatcccataaaaatcaagtcggatgacaagaaattgaccaactggagttgcggctctcattgtgtgttcactgaaactgaacaagaaaacgaggtcattgcatggggtaataacgaccatggccaactaggtattggaaagaaaactatgaaatgcgctaagccaatgaacattcccgaagttctcaaaccaggacaagacacgacagatttggactcaatttataacagtaaattacacttaaaaaaggagcaacgtgtagtcaccaatggtaataaaagttgcttatactggcgggtttgagaaacgaaagagcatagaaggaaagtagcgagattcgcgatgttttttcaacccttataatgatgcatgtatatatggtatgtttatttatatatagaactcacggttacttctatcttaaccatttcaacacataataaatacctatgatcaagagaattaacgcgatccaaaagactagtttatctttgaacacccgtttattgatagaggtgatagtttgttccgaaacacccaatgttcttaggccatttgacattctatcttgtaccttggataaaattttgttttgttccactatattttcgaatgattgttggcccatttctagaatgtaatctaattgagcgttacccctttcgaaaacagactgttccttttgtagcccttggtacaacggtagtcccccaccgttgctagagccctctttaccatttgcactcgcaccaccaacgttccttttattcatgatggtctctgatgtactaaaggggttatcggagtccataacatgcgatgctcctgagccaaacaactgagttctggaattattttcgttgtaggattgttttaaatccttaaacttggcagtaaagtcgtgcagatcctgtgttaaagttgctagtcgattagcgaacttaggatcaatttcctctgcattagtatcttctttatatctgtttaaatgttctgcatattgcttaactgtcttctccagtgagactaaagttgcagagatggacccttgtaaagaaataggggcggtcacagaattcttttcaaacctggccaactcttgttgtagttgatttttttgcttcacagcatggttgtaaagagcgttctatttgatggtagtagcaaaataccctgttagtattacatcttgttttagcaataatgagaaaagatgcctccggcgatcaaacataccattcccccctcaaatcaatatgattaagtcacgataatatctgcactattgccgtgtttccttctccatcgacagcgtcgatcctgtctattatagccagcacactgaaaatttcaatggctggcttgttgttcgcgtcgcaacttttgatatttataaaaagagagaaggtatatccaaaggataaggtattgtctttgtaaatcaatcaaccaaacctctacggaattttgacccttgaagcagggactattacactaaaatgactccttccaccccaccaaggtccagagggactaggtacctagcgcagcctagtggcaatactagttctagtgccctaatgcaaggtcaaaagaccccccaaaagccttcacagaacctagtccctgtcactccctcaacaactaagtcttttaaaaatgcgccattattagcacctcccaactcgagcatgggtatgacctctccatttaatgggcttacgtctcctcaacgctcgccgtttccaaaatcttcagtgaagaggacactattccaatttgaaagtcatgataatggaacagtaagggaagagcaggaaccattgggtcgtgtaaataggatattgtttcccacgcagcaaaatgtggatatagatgcagcagaagaagaagaagaaggagaagttcttcttccccccagcagacctacatctgccaggcagttacatttatcacttgaaagagatgagtttgatcagacacatagaaagaagattattaaagatgtacctggtacgcccagcgacaaggtgataacatttgaattggcaaaaaattggaacaacaactctccgagaaatgacgccaagagtcaagaaagtgaagacgaggaagacatcatcatcaatccagtgcgggtgggtaaaaatccctttgcatcagatgaactggtcactcaggaaattagaaatgaacgtaaaagggcaatgttgagagaaaacccagatatagaagacgtaataacatatgtcaataagaagggagaggtggtagagaaacgaaggttaacggatgaagaaaagagaagattcaagccaaaggcattgtttcaatctagggatcaagagcattgaagaaatgaaaaaaaaaagtttctggaacgattatattttatttacttacttattctacatttatttgcaaaggggcattaacatcaacattttacatattataatatatacaggatattctatattacaacattaacaggatttttaacttttccttaccgtattcttttattctggttttctgtcttcagaataatagcatatttcattgtagtatttcgtcaaagcgagttaggggaggatgactacaagaaagacaggttcctctcttcagcttttagggaaaatcacaggaacaaaagctggaactaagcaaaagaagatgaatttcattaatggactgatatggttatatatgtgtgtgtggatggtgcacggaaaagtgacgcagaaggatgaattgaaatggaataaaggatactcgctaccaaatttgctagaagtgacagatcagcaaaaagaactttcacaatggactttgggtgacaaagtaaaacttgaagaagggaggtttgttttaactcctggaaagaacacaaagggttcactttggttgaaacctgaatattcaataaaggatgcaatgacaatagagtggacgtttagaagtttcgggttcagaggcagcacaaaggggggtcttgcattttggctgaagcaaggaaatgagggggatagtaccgagttatttggtggaagttcgaagaagttcaatggtttgatgatattgttacgattagacgataagttgggagagagcgtgacagcgtatttgaatgacggaacaaaagatcttgacattgaatcctcaccgtattttgcgtcatgtctgttccaataccaggattccatggtaccatcaacattaagattgacttacaatccactagataatcatttgttaaagttgcaaatggacaacagagtgtgtttccagacgaggaaagttaaatttatgggcagcagcccatttaggattggaacaagtgctatcaacgatgcatccaaagaatcgtttgaaatcttgaaaatgaagctttatgacggagttatagaggattcgctaattcctaacgtgaatcctatgggacaacccagagtggttactaaagtgatcaattctcaaactggtgaagagagtttcagggaaaagatgccattttctgataaggaagaaagtataacgagtaacgagcttttcgaaaagatgaacaagttggaggggaaaatcatggcaaatgatatcgatccattactccgcaagatgaacaagattgtggagaatgaacgtgaactgattcaacgtttaagaccactgttagatctgaagaaaacagccataagtgacgatagtttccaagattttctttcgatgaacgcaaacctggacagattgataaaagaacaagaaaaaattcgacaagatgccaagctgtatggcaagcagaccaaaggtcatgatgagatattttccaaaataagtgtatggttggcactgctgattttcattatgatcacattggcgtactacatgtttagaattaaccaagacatcaagaaggtcaaacttctgtaagctcttgtgtctttgttatatgggtacaagatataagaaacataactattacatacgaaaatgtgcatgttatctatatccttctttatatagatgctgttaacttcttttttttttggaaaaatcaattgttaaacgcgacggtaaaagcagcaaaacattaattttgcttccaagactacagtaatatgtctcctacaataccagtttcgctgcagaaggcacatctattacatttactgagcataacgggctgtactaatccaaggaggtttacggaccagaggaactttccagattcagatcacagcaatataggactggaaaacatcaggtagccgcactcaacttgtaactggcaactactttgcattaaactccaattaaatgcggtagaatcttttcagaaaaggtattcaacgtcaattcggaaagcttccttccggaatggcttaagtaggttgcaatttctttttctattagtagctaaaaatgggtcacgtgatctatattcgaaaggggcggttgcctcaggaaggcaccggcggtctttcgtccgtgcggagatatctgcgccgttcaggggtccatgtgccttggacgatattaaggcagaaggcagtatcggggcggatcactccgaaccgagattagttaagcccttcccatctcaagatggggagcaaatggcattatactcctgctagaaagttaactgtgcacatattcttaaattatacaatgttctggagagctattgtttaaaaaacaaacatttcgcaggctaaaatgtggagataggattagttttgtagacatatataaacaatcagtaattggattgaaaatttggtgttgtgaattgctcttcattatgcaccttattcaattatcatcaagaatagcaatagttaagtaaacacaagattaacataataaaaaaaataattctttcataatggcagttgaggagaacaatatgcctgttgtttcacagcaaccccaagctggtgaagacgtgatctcttcactcagtaaagattcccatttaagcgcacaatctcaaaagtattccaatgatgaattgaaagccggtgagtcagggcctgaaggctcccaaagtgttcctatagagatacccaagaagcccatgtctgaatatgttaccgtttccttgctttgtttgtgtgttgccttcggcggcttcatgtttggctgggataccggtactatttctgggtttgttgtccaaacagactttttgagaaggtttggtatgaaacataaggatggtacccactatttgtcaaacgtcagaacaggtttaatcgtcgccattttcaatattggctgtgcctttggtggtattatactttccaaaggtggagatatgtatggccgtaaaaagggtctttcgattgtcgtctcggtttatatagttggtattatcattcaaattgcctctatcaacaagtggtaccaatatttcattggtagaatcatatctggtttgggtgtcggcggcatcgccgtcttatgtcctatgttgatctctgaaattgctccaaagcacttgagaggcacactagtttcttgttatcagctgatgattactgcaggtatctttttgggctactgtactaattacggtacaaagagctattcgaactcagttcaatggagagttccattagggctatgtttcgcttggtcattatttatgattggcgctttgacgttagttcctgaatccccacgttatttatgtgaggtgaataaggtagaagacgccaagctttccattgctaagtctaacaaggtgtcaccagaggatcctgccgtccaggcagagttagatctgatcatggccggtatagaagctgaaaaactggctggcaatgcgtcctggggggaattattttccaccaagaccaaagtatttcaacgtttgttgatgggtgtatttgttcaaatgttccaacaattaaccggtaacaattattttttctactacggtaccgttattttcaagtcagttggcctggatgattcctttgaaacatccattgtcattggtgtagtcaactttgcctccactttctttagtttgtggactgtcgaaaacttggggcgtcgtaaatgtttacttttgggcgctgccactatgatggcttgtatggtcatctacgcctctgttggtgttaccagattatatcctcacggtaaaagccagccatcttctaaaggtgccggtaactgtatgattgtctttacctgtttttatattttctgttatgccacaacctgggcgccagttgcctgggtcatcacagcagaatcattcccactgagagtcaagtcgaaatgtatggcgttggcctctgcttccaattgggtatgggggttcttgattgcatttttcaccccattcatcacatctgccattaacttctactacggttatgtcttcatgggctgtttggttgccatgtttttttatgtctttttctttgttccagaaactaaaggcctatcgttagaagaaattcaagaattatgggaagaaggtgttttaccttggaaatctgaaggctggattccttcatccagaagaggtaataattacgatttagaggatttacaacatgacgacaaaccgtggtacaaggccatgctagaataatgcgtttgaagtgagacgctccatcatctctcttaatttttcatgactgacgttttttcttcattttaattatcatagtatttgcttagaaaaaaaaaaaaaaaattcccttatcaatgatatccttacgattatataaattccttacctaaacctattatttgtgtacatatatcagagtattattacatatataacctttttctctaaaacaggaaaaaaaaaagaaaacgataacatgctctgccatcctttgttcaccgagcaaaattaaaaacgcaaaatgaattgtccctatgaaattattaaaggaccacatcaccagacttatctctggggggtcctctagaaaataagtcaggtacttgcctggactttcttccagttgaattcctgagctaacatacaattaatggagtgagaatgttcgaacgatccaggagttgcttttttcagtcatttgtttatcagtgtaacaagcatttcctttatttcttttatatcaacctgcaacctattaatattcaattcaacgtctcggagcttttctcgtaccgttttaccatcatccatttccatgctaactaattctgagattacgattacatattgtctcagttctggttcatcaatggctgataaaactttcattacattttggaaaaaatcttcgtcatttaggtctaaagtcaggatttggttccttatagactctctacgatcttttttcaagtttttttctgaagaaatatgtccatttccattagtgacagcggtagagtcctcttccgctcgaaccaaactatcactgccggtgttttcctctcgaaagggtttgtctttaccaatggaaagacgcccgtcttctgcgctttcatataatttgacagtggctatattgaactgttcttgcaaatcgccagttttggcatcccctacccaacccttttcatgcaattcctttccttgagtgacccaagcgacgaggttatctctaatatatcttgaagttataggtactcttgatttctccttataaactctgttaaaaaactcagctatcatttgatgacataatataggtctccttttacttgctctttttgttgtgtggagcaagagggcccaatatatgactgttaacttttcacaaagacttttttctttattattggaccatcgaaacttccttagttgccttgtttccgcttcgtcattactgtttccccccaagtctgtgggggctccaacgtgcaatatgtcgttgtcaatatcactagaagtatgagtttccacattcaacttggtattagtagtgttaattcttttattaaagcaaatagtatgtgtagattgcaggaggtcgaagctcttcggattggcaaaatcaatattctgctctataattttcacaggttttgttggcagtatttgtgcaattcctgtcattgagtttctaaatacattcttttggtcatattttgaagtgctctttttgcttttatgtactttttttgaagaggacgcattcacatttgttacttccaatttctcttcctccatttttggcgtttcagagggctttccgtaataatcttcaaaggaatttaaagtaaaattcttaaagttggacatccaaaaggatcttcacaatataagcgtttttctgtccaccagcttcaacaagcttcagcctactaccaatttctaatactgttttatcttattacttgcttacttatccactcccattgttttgtcctagatgacagcatcacccggactgaatattaaagcgtcagtgtcacttattttaagtcataatcaagtccttttaatgtggctatagattaaccctgtacactaaagctgtatattatttccttaaaggagcatttatttccaaactgtaacgcagaatgtcattccagaatcatggaaaaaggattcaaataaataaatgtatatacaccaaaaattacaacttcgaatcctatagtacttttaatctttttgaaaaaaatattactaaaaactatgtatcatgtccaaaggccatagggcctagcattttctttgttaaaaagataaacagtagagaaataaataaaaacgccctaacccaacgtataggacctctttttcgttggcctagtcaactttaatggatgagtagatttttctaacaaagagcatactgctgataaagccaattgaccccgttaccaaacagcagagtaatgaaatgactgaggagtatcccacgtataagacaatagtcgtgaatccacccaacttaaatttggtgaataaaatagaatgaataaacacatacaaagcacaaccggcacctccaattatgaatcctctccattgccacttccagttctccaggcataaggaatgataagtgatcaaaatagtgacgagtgaacttgtcaaagttaataggaggaaagagaaaaagaggaaaccaaacatgtaaaaaatcttattaaaccataaacttgtgtatatgaaatacaactcaacggcgatggagccaaatggaaagataccagcaatcaaagtagctggtatagtctttaaataccaaggctggaagggtatttgtcttgcgatttgctttgtcttggttggatgttcatcccagtgacatcttttcctggcaatcaatgaaccagcaaatgataatggaattgagaacaaaaaccagagaaaaaccataaaaaacagagtacttgctggtatgacaccagaagaatgaacaaacattaagaaaaagttcaacgcaataattattagcagaatagcaccaggaactagaagtggagtcaatatcaagtttgccttccagtatggcccattgaaaaatttgtagatgcccatagatgtataagagccgacaaacccgaataatgcatataagataaacataacagtggctaaggaacctctagaactaggtgataggaaacccaatgcagcgaagaagatactgcaagttaccatcaaaaataattgaactcctgaaccaaccaaaattgaaagggttagcgattgacttggcgaacgaaaaacatcaccatgattcaatttccaacctgaatcttcttgaaaatcgtcgtccaaatttaactcgttgtaacgtgcgaaatcacttttcagtgcgcgcaatagcgaatggataacaacagatgacaataagacaacaactaaggagaaatttatcaaagaaaaccattgaatagaaggatcatatacgtgtaaatatttgtcccatctggtggcccaagaagtcgctgattcactgaatttaacggaataagtaaaataaacttcattatcattttcttcgtctagcatcaatgggctgccagtcgtttcacatgtacctggactggaacgttttatggaaactggttcgacgataacaccaactacacgatagttaccttcaccgcgatcgtgatattcaatcataatatcgaaatggttggcaaagtaaggcaattcgtaagttttcaccatgttacgatcattacgtgtttccaattccacatccttatcggtggtttctaccccttttggagtagcctcaatgtcggttccttgagttacctgtacaaaaccaaggttgaagccagcaccataaaaactagtcttagttctgccatcataaacctctcttgcagccggtaatccatcaataagccagttttggaagaagccattttttatcaatttattgatgaatttagcatcatctcccggaattacggtcttacacagggattcacactctttttcttgtaacatattcaattggaatggtgaattataaattcgatcaccaaatataacggatcccaaggattcaggttgcttttcgactttttcaggctgacaaaaatggaatctattgtaatagtagtcgtatgagtacaagaaattttctttatcgccagaaacgttattaccgtcctcatccttgtgttgataattcattgatggagttaaatgattaacgagcaatgggatgttgtcattttccctgtaagtggtaggcgctacacctggtaaatagaaggctttgactgttgacacaaaaaaatacaacaacaaaagctgtacgtgtgccattttgtaaatcattctgttttgttttcctttcggtacttgctctctgctactaaattaatatctgaaaatataacggtagcagatgaaggaaaagctggacaaggagccaaaaattaacttaactaacgtaccaaaaaaagatacagataaaaaaaacaaagcagttcaaaaaccttgaattacctttttgtttatcattaggcctatttcttcgaaccgatgacatttttcatggcttcaccaagtaaagaaaaattgccgtgaaaaaaatttaaagggctgtaacccggacttttgtattataagttaaaatcactcattctcaggcagtattgataacattccaagtgacttccaatacgtgttgaatttactactaacattccagtgtaagtagtaatttttattaagttttgatcaacttaggattttcctattttatttttgtttattatattaagtgttcattattttaagtagttatatattatataatacaaccccgattagacaaacttcataagtttttcgggtgggacggtatcaagcatttcattctcatcaattcgcggtttaatgggcttataatcaccctctggatccttaaacacgtaggcaagaatgacgcctgcaataccaaggacagaaactgtccctaatgctagtgcaagaccaattaaaacgacaaaaccacgacctattttcttcttcttcgattttgatttagattcactgcttgccgatgaagatggaggctgggatgatgttgacagaggacttgtcacagtaatgttcacattggcaagtggtgactgagagttgaattcagttgaaacgtctctattaataaaaattattggattgtaattggaagtatttgttgtttctgaaataaaatatggggtccatttttggaaatcaaacaacatactttgtaggtatccgtattgcgaaatattaaaattaccattaagtaagaggatactgccattattaacgttgttgattcctctcttgttcaaagtgttggattcaatatctgtgtatatagctgaaacagagctaatagagctatcattgccaggtaacgaggtaatattccattcttggtttctatagataaataatgaagtatcattccatgccactatggagtcttcagtgacagtaaacgaattcagtttcccttcagaaccactcaataatggaaccatagtagaattggttaagttaaaggatcctaaacgtatagattggtattcttttgtttcaaaaaggcctgagataattaattctgatgagttggtgaaggaaagttgtgtgatttcaccaaaaatcgtgttattgaggaaggtagaccaacttttgctttcataattgtatagacataatccggtgcaattcggctcagtcatttggaaatctccgccgacaagcatactacagtttttttcaaagttaactaaagcatttattctagcatttgatcctagtgtttcattagcaatcatggtcaaatttctcaaatcaaaaatcgacagttctgctgtggttgaagatcctgcactgacagctagtaaagtttgattatcagcgtatagcatttgagtaataccgctagaccaattccaggaaggataaacgtcattagaaaaataaattttgtttagagaatccacctcatatgcatatgccgtggcagactcatttaaataagctcccaggtaaggtacaatacccccttctaggttaagtggctctatttcattttcgttcaaaaaacgtacagacccattcaaattaccatattgcatatgagatactgcacctgaaaacaaaacatcgccatcgccattgttaccagccgcccaaagtgatagactaaacgaactggagttccgtataagcgcattggaagatgcattgaccacataatcgttatcaagaacaataaagtcgttatttgcaagacttatattaagggcactattcactgtcctcgattggttgaagacattctcaaatgatccattaaacaaaaaaacagctgattgattatttgatgaaagaatatctccaaatattagtaaaccttggttagttttcgttataccatgtacatcaccttgaatggtttggtttttacttgatgtaacctcaaagtcgtcattaaggtcgacaatggaaatacggttgcttactccaccgattactaatttgttatcgtaaatgtcagcataaagggaagaatttttagggtaattttttactgggaaaagattcaaagtagtattacctacctttgtttcgttcaatctcgtgttggtaaagtttgatttctggtattggagaataccattcaataaagtttcttttttagcgttgctagaatctgaaagtgtgttaaaagcatctaaagaaacagtaatgacattaacttgatctgccacgaccactgttgcagtgttggttgtataaattcctgagacatactccaaaacgatctccggtgagaaatctagatatcccgagtagatttgatcatattttagattatcattgttctggtaaatcaagtacgtcttcattattgtgttattttgttgattccacatggtcacgtttacaatacctcttgcggagcacgtattatcctgaagacaccctggtgtatacatgttgatagtgtagtgaccggggtggataatgtttgggtaaaactttacgcgtggaattggctcattttgatctggaacatatttcgcggctatataactttcacctgttaggccattataccaatcattgcttgacaatgtagatgacgacgaatcattggtaagcgcgctgcagccatattcgttgagagaatcattagcataagtggagaatgtgtcctgatagagctccaaaccggataatccaacactaccaccgtatgaatttaatgctacgaattttaacgatgaaacgggaagttcattcacaaacgcaaagtcttggaaatctgacgtccattttacgtctgtcttgttgttatcgatgaaggtaatcatgtccatggatgaagatacattttggcttgctgatagtaaagtggctcggctatacaaagggcaaaattcatcgcaattcttcaactccccacttagtgggtccagatacgttaaattcattatgctactggatggatcagtcagaatttggaacacggagatttcactatcggaactttgggaattataaagccttatttttgttggtgaaacttcatatggtaaattacaaactagagacccagacgtatccggataaagccatgcatcctcattagtgttaggacaaactaacgaatcagatgcaaacgttgtacttccctgggaatcccaggaagcgtacctcagtggaattcgttggcctagctccaatgtagtagcgtttaacgaggaggttgagttcgtaccgttatttgaactactgataagcgcagaaggatcatccagtgtataaaactggcctgcaaataaaatgttgtcattatttagcttgactatggaattcacactggagttttcaccaaaccctccaaaaggtaaaagttgggtggtatttgatatggagtcccaaatgagagcactatagcccgtcatgaagccattattatatgaaaagtttcctccaaaatagatagaagaattgtctgcgagcacagcctgaacagctcccaaagactggttgaatataggcgtcatagacagtgtcgacaaattgtataatatctggtttccgacagagatattgtttatcgtgcctgatccgctaagaataaacgaatcaacgccaaatggtgtaattttgtctattcgagtatcatcagaggcatcttccaactggatataggtgttgttagagtaataaactaatccatgtgagcttgtttctggacctatttctttagtgaaattttgttggcctgtgtactcgtaaaaagataaggcgtccacacccccgaggatttgtactgcgttgctattattttgcgatatattcaaattcggtagcacattatcttcgatgtccagaagagatttaatattctccaactgtgatgccttcgatatctccacaagaaaaggaaatgcgagtgtccagagacgatgaacaaacatttaatttctatatcgtaacgaagaacaggtgtattttgatcgttttctcttgcgtttcttcgtttcccggtcaatcaactgtataaatataaaacgaaaattgtattatcttctcctacaaagtctagtatggggatgattaaagcgcacactttccttcgagacttctgatgatgacatttccacatttccatatatttctttttttgtatcgcgaaaaaatgggaagaatggcgtttctaaccactaaaaaagaggaatttttgcctaatttgggaatttgtcaataaaaatgtaaaacatatgagatgtattattgcctgcggaagattcttaaaaacatgacaaaatccaaattgaaaatgacctgaaggtctcgacttttcggattttcattgttgctatgtaaatctatagttaattatatccaattctggtaaccaaacctgtgcttcgtacaccaatcgggaccatgctcatagtattcttctcttgtgaccctcgcttttcggtaggaatctgtctttgcaaactgtgacatcacttcccacccaaacagagcacagtcaccttcgggcaccgaaacatgacaagtccaatctgtgggtaattgcctttgtagttctgccgcaagccgttgggcgaaattgggcagattaaagtttcctcctgtacatacaatgtttcctaccataagaggtcgcactatttcgggcaacatggaaaggctctctaggatggcctccacaatgcctggtttagtaatttgcgaaatttctggatggaaaaaagtttctggtattgtgaaaagctcatctgtcagtgttatgatctgcgcatcttcaggtaacggtacattttcttttctggggtttcttacgtaaccaagaaagcttgtttggaagtcaggaagtacatattctagtgcatgcttatccttcgttttgaaactatcaaaataagacaccgggctaacgaacaagcattgttccttgatattgttaacaagtatggtttcatccatcatattgtagtgtctgaatgatagagtttcctttagtagcccagttaggaaacggcctccaatgtccaatttttttaccgctttatagtacggtattcccttcaggacaggaattatccaagtacaattaaacccggaatcaataactaattggaaatcatgataatcgctacctgaatcctgcgcattcttggactcgcttgatgtggaatttgtactgtctgagttgccacggacaatatcgatatcttcgtccttacctgaaattgttctcatttcacccttatatgacttggtaaatggtacaaagactgctacaggagacttgaaaagactgtcgaattcatattcttcaaatatcacctggtcggcatgcttacttaattctggtaaagtcatacagctctcgctagcaaccaaatgatgaccctttccctctttcagatcaaacccatcaaactctgaaggattgaaaaggcaataatcccatatacaactctctaattcccataatgtgagctgtcctagttcatgtggcctcctgaaggtgatagatgaaatatctttgatgtttttgatatgatttgataaatacgatgtcccaaatttatctttggccaatgcatttaaagctcggaacggtttcttattcgtggaaggaccaaacttgatttcgtatgagccattatcaatcacaatgggtggtgtttccatagtttaaattatcttgtccacgattctgcgcttcttctcctttggtcttgcattaattctcttgttcttcttggcccattttgaaatgcatttgtaattatggacggaaagtaaactgtttacaataatcacgaaatacatataggttcacatcatctacacattggaatcgatttcataccataaaagaggccctataagaagcggcatcaccttaaacactaaccacgtgcaaccaacagaatatatttgatgtctgatagtccattgagcaaaagacaaaagcggaaggccgcccaagaaccagaattatctcttgatcaaggtgatgccgaagaagaatcgcaggtagaaaaccgagttaacctaagcgagaatacaccagagccggatcttcctgcgttggaagcatcttattccaaatcttatactcccagaaagcttgttttgagttctggggaaaatcggtatgccttttctcaacctacaaactcaacaaccacgtcattacatgtaccgaacttgcaaccaccaaaaacctcttctaggggtcgcgaccataagtcctactctcaatcaccaccaaggtctccaggaagatcgccaactagaagattagaattgctccagctttcgccagtgaaaaatagcagggttgaactacaaaaaatttatgatagccaccagtcgtcgagcaagcaacagagcagactatttattaacgaattggtcttagagaacttcaagtcctacgctggtaaacaagtagtaggtccctttcatactagcttctcggccgtggtaggccccaatggttcaggtaaatcaaatgtcatcgattccatgttatttgtatttggatttagagcgaacaagatgagacaggacagattgtcggatttaattcataaatcagaagctttcccaagtttgcaatcatgttccgtagctgtgcattttcagtacgttattgatgaatcttcgggtacttcccgaatcgatgaagaaaaacctggattgatcattacaaggaaagcctttaaaaacaactcatcgaaatattacataaacgaaaaagaaagtagctacacagaggtgacaaagcttttaaaaaatgagggtattgatttagaccataaacgatttttaattctacaaggtgaagtagagaatattgctcaaatgaagcctaaagcagaaaaagagagtgacgacggactactggaatatctggaggacataattggaactgcaaactataagccgttaattgaagagcgaatgggacagattgagaatctaaatgaagtttgcctggaaaaggaaaatagatttgaaattgttgatagagaaaaaaactctttagaatcagggaaagaaacggcgttagagtttttagagaaggaaaagcagctgacgcttttaagatcaaaattatttcaatttaaattgttgcaaagcaactctaaacttgccagcaccttggaaaagatctcctcttcgaataaagacctcgaagatgagaggatgaaatttcaagaatctttgaaaaaagtggatgagattaaagcacaacgtaaggaaataaaagatcgaatatcatcttgtagttcaaaagaaaagaccctggttttagaaagaagagaattagaaggcaccagggtgtctctagaagagagaacaaaaaatttggtaagtaaaatggaaaaagcagaaaagactttgaaatccaccaaacattcaatatcggaggccgagaatatgcttgaagagcttcgtggacaacaaaccgaacacgagacggagatcaaagacttgactcaattgctggaaaaggaacgaagtatacttgatgatattaaactatctttgaaagataaaacgaaggatatatctgcagagattattcggcatgaaaaggaactggagccttgggacctccaacttcaggaaaaagaatcacagatacaattggctgaatccgaactatctttgttggaggaaactcaagctaaactgaaaaaaaacgttgaaactttagaagaaaaaattcttgccaagaaaacacacaagcaggagctacaagatcttatcctcgatctgaaaaagaagctgaactcacttaaagatgaaaggtcgcaaggtgaaaagaattttacttctgctcatctaaagttaaaagaaatgcaaaaggttttgaacgcgcatcgccagcgtgcaatggaagctagatcctctttatcaaaagctcaaaataaaagtaaggttttaacagctttatcgagactgcaaaagtcaggacgtataaatggtttccatggacgtttgggcgatttgggcgctatcgacgatagttttgacattgctatttctactgcttgtccgagactggatgatgtcgtggttgatactgtagaatgtgcgcaacactgcatcgactacttaagaaaaaacaaacttggttatgcaaggtttattctcttggataggttacgccaattcaatttacaacctatcagtacaccagaaaatgtaccgagactatttgatttagttaaacctaaaaacccaaaattctcaaatgcattttacagtgttcttagagacactttggttgctcagaatttaaaacaagccaataatgtagcatatgggaagaaaagatttagagttgtcactgtggatgggaaattaattgatatttctggtacaatgagtggtggtggcaaccatgtagcaaaaggtctaatgaaattaggtacgaatcagtcagacaaggttgatgattacacccccgaggaagtagataaaattgagcgtgagctatctgaaagagaaaataacttccgcgtggcaagcgatacggtccacgagatggaggaagaactgaaaaaattgagggaccacgaaccagacttggaatcacaaatatcaaaggcagaaatggaagctgattccttggcgagtgaattgacactggcagaacaacaagtgaaagaggcagaaatggcgtacgtcaaggcagttagtgacaaagcgcaactaaacgtggtgatgaagaatttggaacgcttgagaggcgaatacaatgatttgcaatccgaaacaaaaactaaaaaggaaaagatcaaaggcttgcaagacgaaatcatgaaaattggtggtatcaaattgcaaatgcaaaattcaaaagttgaatcagtttgtcaaaaattggatattctagtggccaaacttaaaaaagtcaaatctgcctcaaagaagtcaggaggagatgtcgtaaagtttcaaaaactgctccaaaactctgaaagagacgtagaactatcatcaaatgagttaaaagtcatcgaagaacaactaaaacatacaaaactggctttggcagaaaatgacacaaatatgactgagacgctcaacttgaaagttgaattaaaagaacagagcgaacaactgaaggaacaaatggaggacatggaggaaagcatcaatgaatttaaatctatagaaatcgaaatgaagaacaagctggaaaaattgaactcactgttgacgtacatcaaaagtgagataacgcagcaagaaaaaggattaaacgaactatcaattagggatgtaacccataccctgggaatgttagacgataataaaatggactcagtgaaagaggatgttaaaaacaatcaagaacttgatcaggaataccggtcctgtgaaactcaagatgagagtgaaataaaggacgatgagacttcttgtgacaattatcatcctatgaacgttgatgagacttcagatgaggtatccagagggataccaagactttctgaggacgaattaagggagttggacgtagaactgattgaaagtaaaataaatgaattgtcatattatgtcgaagagactaacgtggatattggagttttggaagagtacgctaggcgcttagcagagttcaaaagaaggaagctggatttaaataatgctgttcaaaaaagagatgaagttaaggaacaattaggaatacttaaaaagaaaagatttgatgaatttatggctggctttaatatcatatcaatgaccctaaaagaaatgtaccaaatgattactatgggtggaaatgctgaattagaacttgtggatagtctagatcctttttctgaaggagttacgtttagtgttatgcctcctaaaaagagttggagaaatataacaaacctttcaggtggtgagaaaacactaagctccttggctttggtttttgctttacataagtataaaccaacccccctttatgtcatggatgaaatagatgccgctctggatttcagaaatgtctcaatcgtagctaactatatcaaagaaagaaccaagaatgcacagtttattgttatttcgctgagaaataacatgttcgaattagcgcaacagttagttggtgtttataaaagagataatagaaccaaaagtaccacgattaaaaacatagatatcttaaacagaacttagctagtacaataatcaattcaagagcacttgctgattgtaatatcatgctatcaaagaagtttaaagatactacccaaattcccgcctgtttatttcttcttttgggcagcagttaggaataaaaaaaaaaggtcaatgataatgcaccaaaaacagaaagtatatgtatatcttaacaaactctcaaaatacaatttaaacaaagttttttgaagcaaaattcgaatgcaagattcataaatatggggcgtaggaaatctatactatatgcaaatatcacgtagttaaaaaactataaaacataaaccagaaatatggtatcaaggacttttgaatataattaggaacgagattaatgcgtatcatctagtatcttgacatactgcttttctgcaagataaacaagcttttggacggggataactgcggtttggtgagtgaatttcggaaatttttttctattgacaccaaaccattccataggtggagtggcgtctcccagatctcttatctgaggcacttcgatctgcggttcttctagtgcaatataattaaactttgaagcggcttcttcctttttaattgattcttcaagttcttcctcagtttgtccaaaggaaatatttgctacctgggatcgacgaactgccagtgctttgacatgtgtagtccacatttcctttatgaagtctacaggccctagattccaccttacagatattttgtctgaaaaagagcaagcaaatagatattctaaattatttgtcttttcttcttgtaaagttgtcatatgaacagcaagttttggaatatcaatgatagtaccaccgacaatcttggaagcataatgcatgtaatcatcaatagcaatggaagctccaacttcctcatctaattcttctttggaagtagaaagcgctgcagaaacatctaaaacttgtagttgcaaatctgtctttaattttttccccgaatgtgtttcggaacgtatagagactttttcaattcttattactaacacttccacatcgaataaagatattggcgaaatctggacctttgaagaggagatattcaccgagagatcagttctgagtagtttcagcgatcttaaaatgtctttgtataatattggttgcctagattcaccaggattggaatctctcaacgtctccatatacgatattttattatcctgcctcatacgtacaatggtgttgtagatatccagtatatttgctacaactaatgcagtagagctgaggataatttcatctgatgaaaaagagacctgcagcaaatcaggtagaacccccttggcatccttttcattatgaagatggaagtgtatgttacttatagtgccgattaagaacatatgataatcaaaagcagcctttaccgctatatcatcaatattcagggaggtggaaactaatggatgagtatttttgcttttttcaggtggccattttacttctgataaccaacttgcattcgcaacttcaaataaaccactcagtctaccttctgatgtcaagctaataccgtcagtgaaagcatgcagtaactgccgcttctcgttataatgatctgtggccagccatgttctttgtgtccttaatgaaatcataccgagagaaggacccaaatcaacgtctccgctaacatttgtaaaaattaatgtaaagcaccagggtatttccgtacctgcatcggcatagttggttgatgttaatgaactcatttcaatttccttattaacagttctttgcactggccgtgtgtgtaaaatgctactgaacctccatatgtccaagaataaatacaggttctggagctgctttacattgaagaagacgcttagatcagaaaccaaccccgttccatacatactgattacatcaggatgtgtaaataaaagcgtcaagtccatgaaaccaacttcaaaggacgtacttacttctcttgaaaatatgtgcttaatggacgcttttgtgtgttctagagttaaagaaaactccaaaggctgttcagagtcgaactcattggtagccatactgaacaaaaacgattcaaatccaacatctgcctgaaccttagcttttggttcacagctcaaacttaactgttgcttggctgatgttagttttacagccacatcaaattgatccaaaagtcgcttataatcaacattctgcgaagaaggttttgtaaagtttggtttttcgtcggtgctatgtttctttatcatcttttgcagactttcagaaaattccattaataaaggagcacatcctgcatacaaagtattatgcgttgggtcgacagtgattaatgttctgaatttatgtggcttaactttatcttcatcatgtttatatgtacagtttatagtgactactggactttttatttcaaaagatggctcactcttggtttcaatatcttcgtacgtgtaaaccctaaatacaccaccgtcatacttgaaatttgagttaacagatctaatgttatcgagaaagggagccaaactactcgaagcactttcgacactggtactagcataagaattatcattttccgcacgcaaactctcggacacatccagaatgttctttttcagctcttgaaatgctcgcatggattgtaaagtagactcaatgacatccatgaatgacgggacaaagtttacatccagtgcttcaccatgaaatctaaaaaaccaatctttccactcaccacatcttttgaaccagtaggatatttgcatgtttggcaagaaacttctattatatttgtctttctcgtttccttcagagaaaaaagtgcttgaggtattaccattcgcaacagagaaaaaagcgtccacaactgtgaatttcccaaaatccttttcatatgctgaaaacaatctgttataacctaacattaacccaggattggagcctgctccatactggaatatccacccaatacaaaatttataggacaggatgtgtattgaacggaaatttatgggcatttcttttgacttatcacttttaccggtgaacatcttagtgttccaaatattaggggcatggcgtcttgaatagtaatggctcaagtctagcaatttatgcgcgccccacattaatcttaatagagaatcaggagataagcagaccctgaaatgagaactttccacttggaatgactgctccgtatcaaccgttctttgtagggttgatacttttatggaaaagtcgagtaatttggaaagaccaatgggtagtgaccgctcctttattagaaataggatgttttcgatggaaaactgtcccgtcaccttggtttcttctggtaacataccgttattcgtattggtcagagaaagtagcagcatatgtaattcaaacacgaaatacgtggaagccactggcacaagaacaccaaaataagtaatgctagtatctaatgtccaatttatcattatcgagggtgcctgcttctcttttttttgtagatttgaactaaagaataaaggcttcagggaatataacagattgataccctgagaagcaagcttttcatcttgtaaaaaactgtttacaatacggcgcggctccgaaaaggttaacttaatcatagatattgagatgtcaacgtttatcaacgaatagccttctctagaaattcctcctttaatttcaatatcgccaaatgaaaaccttaggtattgctcctttgtctggtgcgatgtcatgaaaaaatcagtatcccatatgcttaacaaaatctcatttgaaccgaatttgttaaaatatatatcaagctgcttggcttcgtgacgaatataaaatggcgagagcggcataacttcagaactaacgtttgaaaaataacatgacaagactgtgttaattttctggtcgacaaattgggactttttctttgatttaggtttaaactttatgcgctctttaatcatcatcagactttccctaatttcagtaatagcggttactaattgctcagttgaactcattgctctaaaatgaagatctgcgcactggttgtttatcagaatcgtaggcttgtgtgaccatgcctcagtagtcgctaaaattgaaaagtcgcgcagttgagcttctcccaaaatgacagatgtgtgttttaaccacacttccgatttctgggaaaatataaccaatgaacccgcttgactagttgaatcttttagattttcccatagtaaactaactctacccccaactgttctacttatcagcttcgtttggtccatgaccagttgcagttcacttttatccactaataaaacggtgttcattttgaattgctttgataactccttttttggatcacttttgtcatcttcgcccactgctgcaatgagtggaataagatcttgcaatttaagtaacctatcactgaattttccttttactgagcctactcttcccgtaatttcaatagtctcttctcgatttgaaggtaagcttgtcaccggaggcgtcaaatccactaccagattggcatccgcaacaacaaaattatgctcaacctcatatccctcaccataaacagtaaggtaaaatgatcccatggtacacttcaacaattttttaatcaaattttgtttatgtttctcattttctgccgtgaataatttgccgtatatatacgaccttgcaacatctgagaactcccaatttctccaagtcgaaaacacagacatgaagatattttttgcatctttcgcagaggtatatttcttttcttttagcacttcgtcgatgttgctttgccaatcatcaggaaggtacgttaaaatgtgtctcagacgcgtaataattttccaactacgattctcacgcacatgccctttggaaagtctcataataaaagcaggttttgttatgacgtaaggatcatgactaatttgataatattcgcttgcggctgtgagctttgaaatgagttctgtctttgaattacttctggtgttctgaatagaattaaaagaagtgcaaacctcttgaataagatttccctggtcactacagtactcaaacagccattccatttgagattcgtctatggtaatatctgatgacgttaagtttaatgagttaacttgtctatcttctgtagaagaccatacttcgaaaccctcaatccctagcgacagtgcagggggacgatcttcagacaagtctggatttttcttctggttaacagtcactctgacagtttttacctttgctaaagctgctacctctaataatttatttgttcggttcttctctagagacttttcactcatttgataatcaatacgatctaaatagagctcaaaaccttcctcacctgtctcttgccaaattaaatttagataagcaatatggatatcaatgtttgaaatagaagtaatcccttcttgaaggttgcttaatcgtttcacaatcccaatttcaatatcgtctaagacttgtaccatgttttcagagtaaagctgttctaataaactcttagcgaaaataaaaagcaacgggtcgacatccaacagaatatatgaaacatcaacaacatagttatccctttcgtggtttctgtcttctgtaaaagcaacaggtttgaagcttgaagggtccgctccttcctcattatcatcttcactgaagctggctcttgaaggctccatagttgatggagtttctgcgaatatgttcttgaatggatttgtggtctccagaagggtagcatactcgcccacaatatcttcaatgatataatctatagtatcaggcaaagtgggaagaggtaaagttgggatagacgaagatggtgctatagccccgtacaggttttggtatgtatccgaatcctgataaaacagcggaagaagaaaaggacacctatgatagggtgaatcgtgtattgttatatatctgcgttgttctgatctttttttatcgatatccttgtattgctcaaagtttgtaaatcttaattttgtttcgaatttgagaaatgatgtgtctacgccatcgcccatcacgcaattcaacgaaattgtcaattttggaattttcacgtctattctttgtgaatatttttcgttttcaaagtcgatcaaagtaaacaatatcgattcagcactaataactgattgagatttcatcaccggatctttaaggcctattcttattttttcaacgtgcacagttagcgaggtcatatcattaatggtctcagtgtcatataataatatattttccaagtcattgtagccaaaacctatcttataaaaggaattaaagaatccctttataaattcaatatctgaatcaatgcataaatctccgagattgatatcccattgacaaaagtaggtaggttctgtgggtggtaatccatacattctatgtccatgaatggtgaggtccgaaagcaatccgtgctcttgctcatcagcaccgttattacgacgtataaaatcaaatacttcatttatttgttttgaaacgtgccgctttattgaagtcccgttgagaaccgccattatgtccatataataattacaacttctgaaatccacgacaagttcggcaaaatgtagtgcaatgcatggatcaaaactgtaaatcgtttctggtaatatcagagcaccatcccaaaccgaaaatgtgaaccaaatatcagtttcgttggtagtccttttcaaatctgaccttttcataggacctttatcctcagattcgttctttagactgctattttggtaccctgaatctacagtagatgccaaatccgccaccgagcttttcgtagtgacatctccgacttccctagcgccaaggacacccgtgtactcttctgacgtcacaaaattaaaaaattcaccgaagtaattcatctttacgtttgttaaatacctcatgacaaacccatagcagtgaagtactgtactcttgctgttacactctatgactagcgtatcgacattatcaatatctaactcggaatagagaaggtaagaacctttaattgtaaagtcgtatgctctccccacttctttatgtttcatgaattcgttcaatgtattccaagggggggtatttaacatcattctgaacattggagttgagatctcgtaggacatatctgtgtatgtccccaaaatactctcacggggtaccgtgacatcaattgaaagcttatcaccatgaagggataaataacagttttcgttaaaatctaacggattgttaacaatattgtgatcattgacgtttaagtagatagaatatccttccatttcccaattgactttgtatacaaatggtctaaaaagttcgtaaggcgtagggtcaccagcggaaaagtctgaaagcgtatctgcaactaaagttatatgctcacgtagcagaaacgcctctaattgttctgacttcatgttaattatccatatagctttgctattccaacccaatggatatccaatatccccatcaatatcgaataccttgctttttaacaaaatatcgtgattaacacttgacctaatttcggtttccaggaaatgaacatggaaattattctgaaaaccttgcactgtaggacaaacacttatattgaaatttgcataggtgtccttacaaaatcggagatccatccatccaaatggcctatattcttcattagtttctttgtagtgtttcaaaaattcggggtctttgctactttccctcgtcggtatacgccaagtagtatcttccattattgatatattcatcctgaaaagtgtatatattcttctagaacctggcgggagtttttttataggtttggctgtccttgaaactaccggtgatagaactctttgtagatgactgacttgtctttgagcccaaggtccgtaacagatggatcctccgtgaatttgaacatctaaagcaaaatctggaggtgctccgttattgcccacatctggtccatcaatatcaggtattgtcggatgtgcaccatgtggcacaacgcccggaacatccacgtcatatgcaattgtgacctttgggcattttaaaattgatgtaaatttagcatattcatggttcgtcaaatcgaactcaacatcatctaaatcacttgctttagcgtcgcccgcagaagccttataaagagataaacctttccatttatgatagaaattgtcatctgatgtgcctgcgctttttttagtctttttcggtacaacaggcttggttactatctgaaagactcgtacaaacgttttccataactttgacactttccctctatctattttaaacttcaatccaatagcatcatcgtaaccaatattttgtttgatagaaatttcgaagtttttgaattccatctgtgttttatttctgtataaatctaatcgctcttttggaggtaaaacatctattatgccttttccactttcataacttagaatcataacagatggcgtgaatttgtttcctaacagtagggaaccgcggctaaatttaagctcaattggtaaaaacatcagtagctttggatgtttgccgatatctgtttcttggtagtccctgtcattaacaattgatgcatcagagttcgttgtgtatgcagattcgcttagatcttcatctaatttatcagcactacttccatcgctaaaaggttcaggaaaagaatgctcattaaggtatttttcaaatttatcgcgttcatcttttgatagtaagtttataacattatcgtacgccactgttctgttgtaaataaaaatttctagaccttcacattctacggaaattttacacggaagctttgcttttttgccagaagaagacttgtcattctctatcaattctgcttttctgcaatttaaaagccagtatttccatgttaaactaccctctaataccgaaatcgtataatctttgtgtattacggaaaggtttttaaaatgtattcgaccacctagtaaggagatacgaagtgtctcaacatttatcttgattttcgctcgtttccatagtagccattctaatataaaacttacaaggtatgcatagattcttcccatgtagaatatcattgtcaaacatactaccaccgtgagaatccaatctactaaaaagacccagctaaagtccttttggtgtgtcaatggaacaccacgtaattgtgaaatagcttccatgcttgctaacttattaccgtcaatagaagacttgagtcaggtggctttaatgagtactattctttttttttttccaaagagcactatgttgataataccgcagtaattttttttgagtatcctgtagcctagaaaggttgaagcttataaaaccgtgccaacagctttatagtggggagtttggcttccctctatttgtatattgatcgccatccctacgaagttattgggaacgcatcgtgaacctctcactttaatgccagcggtagaaaaaaaagtcataaacaatacacgccggctacacttagaaagaaatgacatttgctgtcttataaaaggacttgacagaccaaagacgcgtataatacaccaagaatggccttattggagaagttgcatcgaaggattgttgatatggggcttgtcccgcgtataatcgccttattaccagttatttccatgctatgcgctctatttgggtttatttctatcgctattctgcctatggatggacagtacagaagaacatacatttctgagaatgcattgatgccttcacaagcgtatagttactttagagaatctgaatggaacattttgaggggctatcgatctcaaattaaagaaatggtaaacatgacttctatggaaagaaacaatttgatgggttcttggttacaagaatttggtactaagactgctatttacgaaaatgaacaatatggagaaacattgtacggtgtaatgcacgctcctagaggtgatggaacagaagcgatggtgcttgccgttccatggtttaattcagatgatgaattcaatattggcggcgcagctttgggtgtatctttagcaagatttttctcacgttggccagtatggtccaagaatataatcgttgtcttcagcgaaaatcctcgtgcagcattaagatcatgggttgaggcataccatacttccttagatttgactggtggttccattgaagctgctgttgtgttggattattcgagtacggaagatttcttcgagtatgtagaaatctcatacgacggtctgaatggtgagctgcccaatttggatcttgtcaacatcgctatatccattacggaacatgaaggtatgaaagtttctttgcacggtctacccagtgatcagttaactaataataatttctggtcaagattaaaaatattatgcctgggaataagggattgggcgttgtccggtgttaaaaagccccatggtaacgaggcattcagcggctggaggattcaatctgtaacattgaaagcacatggaaacagtggtcatgatattactacatttggacgtatacccgaagcaatgtttcgctctattaataaccttttggaaaaatttcatcaatcgttcttcttttatttgttattagcaccacgtcagttcgtatccattagtagttatttgccaagcgctgtggctttatctatagcattcgccataagttcattaaatgcatttataaacaatgcttatgcaaatatatccttattttccgagtataatttggtagcgttgttggtttggttcgtgtcattggtaatatcatttgttgtttcacaagcgtttcttctaataccttcatcgggattattgatgacaattagcatggcatcttgttttttacctttgatactttccagaaaaattcacatctcagaaccactatcatacaggttgaaaaatgttgcttttttatatttcagtttggtttcaacatctttactaatgataaactttgcaatggctttactgatcggtacattggcatttcccatgacatttgtgaagaccattgttgaaagttctagcgaacatgaggtgacaactcaatcctctaacccaataaaaactgagccgaaagatgagatagagctcgtcgagaatcacatggatacaacgccagcaaccccccaacaacagaaacaaaaactaaaaaatttagtactattaattttgacaaatccatttatttcaataaccttattcggactattttttgatgatgaatttcatggatttgatataataaacaaactggtttcagcatggttggatttgaaatgttggagttggtttgtactttgtataggttggcttccatgttggctattgatattagcgtcatcgtttgaatctaaatctgtcgtagtaaggtcgaaagaaaagcaaagttaggtgccattggtaagaagtaaaggattaacgggtgttcgaactacgcaattgattttatatgcacaaacattacaaatcgaagcaaaagaagatgaaatgatatgatatactgatacaaatatgtattaaataaaacataagtattgatggaaacatggcatagagaagcgaagatgcgataatatcaaataactatatgtgagttgtggaagaaagaaacgatcacattattataataaactagctatttaaatgtttattgaagactgttctgcccccttttattcagtcacggtattggtcaaaaaattctttatggaaactttcccatttcttaatccattccagaccaggtgccaaaaatgttgttcttaaatggtaagtaccaggttcttggccaaacccagaaccgggaacagtgcaaatgccagtagattctaacaacttcttacaataaaattcatccggagttaactctaagtggcgagcttcttgaactgccttgaaaggtaagtctatcttagggaataaatacatggcaccttggggcttttgacattcaatgccttctaaagagttaaatgtctcatacagtgtcattgctcttgtaattaacttttcatggatggagttacgttctgcttggtccgactcgaatgattcctccccttccactggtggacgaaccatcaaatcaaccaaagcttgacctgtgacaacgggacacaatgaaatcgaggctagtttcaagataacttgtctcatctcatggctgaatccagtgagttccatgtagccacccctttgaccacattcaccagaaacacccttagaagtcgaatgcaaagaagctagctgaacattatcgaatttacctggatgttccctctgtaaatgtctcaaaattttcttcatagaatggaacttggtgcccgggaagatattttcttgataaacttcgtcagctatcactactgtaccgtacttggctgcgacttcaaaaatctgagctatagactcaggtgataggacagctcctgtaggattacctggattgataaccactagaactgtaggtttgatttcgttctgtatagcctctttgacgacagtttcaatttcttctggattagttgaccaacctgaattctcatctaaatagtatggtaaagcttgagaattgttcaaagctagagtagcggtatataatggatattgaggaattggaatcaagacacccgtttctggccctctacagaaaattgataacaagtaattgacagctgcggatgcaccagcagttaggaaaatatcctctgggtatgatatctcgccttcgtccctcttcgttataaattcagcgacacttttccttataccttctacaccttgagaagaagagtaagcaccaacagaaccaccgatatcttccattaaactctttgcacgtttaatggcatctagtttaaacaatttcgaatcaactagctgctgttcgttttggtttaatagttctgggtattgtaagagagacaagacctgtctgtagtaagtcagaggtttctgttgtagttgctgaggattaccaatattggcgttgataatcctatcaaatggcagagattgaggatccttctccagttgagctttcaattcttcagctctcattgggatggcacctctgacggcgtacttagccttcaagacattttcatttacgtcttccaaagtcaattgttcggcgggataaaactcgttattcgaagttttcaacgtgtggtgtggaaagcgattcaaatgacgcaggtcgtttagcgaagattgaccagataatgaacgtctatgattttgagcaacaatccaggaagagctatgtctctgtaggacgggtctaactttcctgaaagtttttaactttgtactactggctgaggtagaaaaaggagtagtgatatgtggcattttttctgcgcttgaagtgagagtccttatatgatatgacttaataacgtgagttatagaattactcactgtgaagtgatttttggcagacagtgataacatcgtggagagagcaaaataaagactggggaaatatatttatatgcgttcaattgagaagcagaaacaattaaatgcgggggagaaacaaagaagctggtcctgttctcgagcaacgtgtgactagtatgaacaactagagtaaaatagcgagaaagcagtagtagtaacggaagagcctttcctagtatggtccgcgggtcacgatcgtttacaaagggcgcagcaaactctaaatacgtcaaccacagcaggtcagaagagtacgtgaagttgtctcaacgaaaggtcgaaaatcgttaggcttggaccccttcagaatgaaaaaaaaaaagacgcaagagtgaaaaaaaaaccagtactgtaaaagcagaaaacgtctaatgggaagtgctactatgtaagattatatcatgaatgtgctgtgtattatatatggattatatagccatgaatatgcggtaaataaacatatgcatatatgtgtgtggggcagcgctctgctgtgcaatccttgtttctttgtttcttgggtcgggatttgagtagcgacgagccatcctctgcagaagggaagaagaaagaaaggcagagaggcaaagaaagagtcaggcttatcttatcttaagagatatgccgcttggacccaaaagaaagggaaaagtaagtacgcaggtatagttttgaatgagtggtagtgatagaggagaccggttatacgatgtgttgggggtgacgagagatgcgaccgtgcaagagattaaaactgcttacagaaagcttgctctgaaacatcatccggacaagtatgtggatcaagactcaaaggaggtaaatgaaatcaaattcaaagagatcactgccgcttacgagatcttgagcgatccggagaagaaatcacattacgacttgtatggtgatgataatggtgccgctagcagcggtggcgctaatggctttggagatgaagattttatgaacttctttaacaatttcttcaataatggaagtcacgatggaaataatttccctggcgagtatgaggcgtacgaagagggcaactctacgagttctaaggatatcgatatcgatatatctcttactttgaaggatttgtacatgggcaagaagctgaagtttgatttaaagagacaggtcatctgtataaagtgccacggttctggctggaaaccaaagaggaaaattcacgttacacacgatgtggaatgtgaatcatgcgctggaaagggttcaaaggaacgtctgaagaggtttggtcccggtttggtagcttcgcaatgggtggtctgtgagaaatgtaatggtaaggggaagtacactaaaagacccaagaatccaaagaacttttgccccgattgcgcaggcttggggctcctgtcaaagaaggaaatcatcacagtgaacgtggctccgggacaccactttaacgacgtaattacagtcaaggggatggcggacgaggaaatcgataagaccacatgtggtgatttaaagttccatctcactgaaaaacaagaaaatttggagcagaagcaaatctttttgaagaattttgacgacggcgccggggaagatttgtatacaagcattaccatatcgttaagcgaggccttgacgggatttgagaaatttttgacaaaaaccttcgacgacaggttactaacattgagcgttaaacctggcagagtagtaagacctggtgacaccatcaaaatcgccaatgaaggttggcccattctagataaccctcatggccggtgcggcgatctgtatgttttcgttcatattgaatttccaccagataactggttcaatgaaaaatcagaactactagcaataaaaacgaatctgccgtcatcttcatcttgtgcctcacatgcgactgtaaatactgaagatgacagcaacctgactaacaacgaaactatatcaaatttccggatcattcacacggacgatcttccagaagggataaggccgttcaagccagaagcacaggattcagcgtatcagaaagcaagaagttcgtactgctgtatccaatgatggcatcaataactttttattctatttttttttttttcataagttatcctacctgtatatatgtatatatatgaaattcatttactgaatgcggtgaaaaatgaagtctttcgcatcttcagtagaaaaataggaagaatcccccatcgcggcggacataaagcaagcatacaaaggtcttgcatcagaacagcgattgcgaacttggagcaacaatggcgtcccaggttaacgccttattactgccggtcatagagtctacgccgcttcatcaaataaccaaggtagcattgacgaccacactcacaagtaaacaaagcgattacaagttcaaagaaatagccgtgccgttaacaaaatcactacaactgtacgagaaggcgcaaagaagacaagatttaagggcaagcttgaaagcactggagagtatcatttaccaaacgcacttccaatggaataacccgctcccacgacatgcgcatctcttccaaaaacactaccactttctactgactcactggccatttgagaaccacagagacttggtagattccatcgctgtaaacaatgggaaactaaactcaacgtcttcaaggagcgtctggctgaaggcggattggataacactgtttaacgttaaaaacccttgggtccaaacgccgccatcgttaatgcgtctgagcgggacagatcttgataccttcacaccagagaggatattcctgataaattctcttggaaaccactacaaatttttaatagcgaacagtcatctaagctacaatcacaaaaaatacccctcccctggcgtgcaaattcctatcaggaacgctcttggcgaagtttctccggccaaacaaattgcccaacttttcgcaagacagctgtctcatatttacaagagcctcttcatagaaaaccccccgctctctcctgagaacgagctggcattgactgccgtcttctatgacgagactgtagagcgacgccttagaaggctctatatgcgagcttgtgcaagggcatatacgactactaatgccgactccaccacggagcctttgatgtttcattgcacccggtgggaagttgattagttgttgttggctgttatactggagtaaatgtcacgtgccactgtggccgtgtcaggtcacgtgaagagagaaattcggccacagttgtggtcttaaacaaggactgaaaaagatcgcagaaactagcaacgtcggatagcggtatggttgaaccaaagtccagtttttagtcatagccggttgagggatgatctgccgttcagtgttctgcgttcaataatacgcatatatatatatatcaaggtatcaacacaatacttgaacaggttaggctcgtactaaagcctgaaagtttttatctttctgtaacatttttctttcttgaggtgtgtgtgtgtatagattagcagggaattatctaagatatgtccagggaaggttatccaaacttagaagaggtagaaattcctgactttcagggaactaacaacaccgttccagatcttgatgatttagagttagagtacgaccaatataaaaataatgaaaataatgacacgtttaatgataaggacttagagagcaattctatagcaaagcacaacgcagtgaacagctcaaagggcgtaaaaggctcgaagattgactactttaatccttcagatgtctcgttgtatgacaattccgtttcccaatttgaagaaacaacggtatcgctaaaagagtactatgaccacagtatacgatctcatctcacggtgaaaggagcatgtagttatcttaagagtgtttttcccatcatcaactggctaccacattacaattttagctggtttactgcggatcttattgcaggaattaccattggctgtgttctcgtgccgcaatccatgtcgtatgcacaagtcgccacgctaccagcgcagtatgggttgtactcctcgtttattggtgcttactcctactcttttttcgctacatcaaaagatgtttgtattgggcccgtggctgtcatgtctttgcagaccgccaaagtcattgcggatgtcacggccaaatatcctgatggagattctgccataactggtcccgttattgcaacgactctagcgttactatgtggtatcatttcggcagcagttggcttcttgcgtctagggtttcttgtcgaactgatttccttaaatgcagtcgctggatttatgactggatccgcgtttaatatcttatggggtcaagttccagcactaatgggttacaatagtttggttaacacgagagctgccacctataaagtggtcatagagagcttgaaacatttaccagatactaaactggacgcagtttttggactaatcccgcttttccttctttatgtttggaaatggtggtgcggaacatatggaccaaggttgaacgatagatacaactccaaaaacccaaggttacacaaaattatcaaatggacatatttttacgctcaggcttccagaaatggtatcattattattgtattcacttgtattggttgggcaatcacaaggggcaaatctaaatcggagaggcccatcagcatcctaggctcagttccatccggtttgaaagaagtcggggttttccatgttccaccaggattaatgtctaagcttggtccaaatttgcctgcatccattattgtgttattgttggagcatatcgctatttcgaagtcttttggtagaatcaacgactataaagtcgtccccgaccaagaattgattgctattggtgtctcgaaccttttaggtactttcttcaatgcttacccagcgactggttccttttcaaggtctgctttgaaggctaaatgtaatgtccgtacgccgttatctggtttgttttcgggttcatgtgttcttttagcattatattgtttgaccggcgcattcttttacattccaaaggctaccttatctgcagttatcattcacgctgtatctgatcttttggcctcttatcaaactacctggaatttctggaagatgaatccattggacttcatctgtttcattgtcaccgtcctaataacggtatttgcctctattgaagatggtatttattttgccatgtgctggtcatgtgcaatgctcattttaaaagtggctttcccagcgggaaaattcttgggtcgtgtggaagtcgctgaagttactgatgcttacgtcagaccggactccgatgtggttagctacgtgtctgaaaataacaatggtatttccactttagaagatggtggtgaggatgacaaggaaagttccaccaaatacgtcacaaattcctccaagaaaatagaaacaaacgttcaaacaaagggctttgattctccatcttcttcgattagccagccaaggataaaataccatactaaatggataccgtttgatcataaatacacaagagaattgaacccggacgttcagattctccccccaccagacggtgttcttgtttataggctatcagagagctacacctatctcaactgttccagacactacaacatcataaccgaagaagttaaaaaagttaccagacgtggtcaattaattcgccacagaaaaaaatctgaccgtccatggaatgatcctggtccatgggaagcacctgctttcttaaagaatttgaaattctggaagaaaagggagaacgaccctgaatccatggaaaacgcgcccagcacctcagtcgatgttgaaagagatgacaggccattgctgaaaatactatgcttagacttctcacaagtggcacagacagacgctacggctcttcaatcattggttgatttgagaaaggccataaatcaatatgcagataggcaagttgaattccactttgtgggtatcatttcaccatgggtgaagagaggtttaattagcagaggatttggtactctgaacgaagaatacagtgatgaatccattgttgccggtcatacaagttatcacgtcgccagagtacctcaaggcgaagaaaatcctgaaaaatatagcgtttataccgcttcaggaacaaatctacctttcttccatatcgatatcccagattttgctaaatgggatatctagccaatgcatttacaatggacatgcaaacatttatatcatctctttttttctatattcctaaaccaaaaagttttcccccttaaaagtatacatttaatatcataatgagatagacactgtttatataataagaaataataggtaggatggtgccatcgtgagcatatacatacctataaatatttaccttatttttattttatttttctcttcctctcaggaacaaaagaaatacaaccgttattaatgttattgtcgtgggacagctcccctttttttttatttacttaccacagatagaaaaacatgaaagcagcacttacaaatagtataatagtgaaagttaataacgtaatatttttgaccttctgccaccacattatttcttttatattgaccgctttgcgcctaaatttattactgctgctatttagttgggaagttttatccaccaataaagaaactctttcttgtctctccaagaacttgtcgatgttatcgttcattatctggatgacgtcctttatttggtcttcggtggcatccccgatgtcacttatagtgttctgaccattcccattactagattggccatttccagaactatttaaagtttggttacggtattcgaccagctcttcatggaaagagtctagtatttgacctacatgcgaacttaaaagttcgtttgtagcgttggactcgtattcctgcagcccacttagtatcctgatgggcaaaatcttgggcatatctactaatgtgaagcaaacgtacacagttttggggtcatggtcatccgtggagtagaaacaatcgaatccgtcgatgagattcattgacatcttggtaactttgttccccttgatcggaactactttgggtaataccatatccatgatcaaattatggaaaatgaccggcgttatctgctcgtttgctgaagttattgtaccatagttttcgtttttctggaacggctggaaacaactagatattgtttcaccattttttataacttccacataacttactaagaccatatgcaaaatcaagcaaaatggaacgttagtctactgaatgtaacatagtaaaattatggcatggggggatgagcattcgcataatcccttttttaaacatttgttaattgtgtagaaatatttatacataccattaaagcgtttcatttggtaaaaatataaaagtccaatgctctaacagcttaataaattgtcgcttttcactctgttcttcaaatttaatagctgttgctccaacttagtcaagtgctagaaaattcatagaggggctttttttcatcattattgtgacctcattttttctttcttcgatcgtttgaggcgaatattacccgggcgcttggtggtaatgcgttgttttaaatattatatataatgaatgtggtggtagaatatatagtttactatttttagataatgcaaatgggtggggtgaaggcgatgaaaaggtggggggtctatcagagaaacctgctgtcacaccagccctttacgacatattgaatctctctcgtaggtgcggaagtcttattggtgactttgcctaaatttagttttccgcatggtttgagcattgtgccgccattgttgaaccatggcttgacgtctgagtgtacgcggaccaaagaacttttcaaatccgccgttgcatgttcgcttgcggattcacggccttgcgaaggttccgtattgcttgtcgttgcaacaaagtgcaaattccagggggtagaatcgccaaaaagatcatttcttgtttcatggaccatgtcagaccataattttttcctagtaattagggcaagcttaatatcgttcgtagagacatttggctcctttttgatttccaaagaccgaatttcggaatacgttagctgcttcaacagatggtcatctacttcgacttcgggtaaaatactcttccttttacatgatgtttcaatagagtataactttaggaaattggtattcaaacttttttgtcttattcttttattgggcaagagctcgctagatgcaatcgaaccgtcggtctcgggcgatggtgatgcagatggccattgttctaattctaccaggtcattttcgtaaatcatgttttctgtagtcgatttgctcctactcttccttcttgaagtcttgccgcctttcttgtcgatgatttggaagtccacagaggtcggacgaagtttggcatcggacgacgcagaaaccagtgaaagggcagaggacgatcgcggacgccgttcgtatacgggaggaaagatatcgactaaatccttaacctcccagtcgtcgaacaaatcgagatcatttatgtttattattttcattttgggcacgaccggctcagccagtacctcatcgccaatcgcgggggtctgcaaatcgacagcgtcagcaatatcatctgtcaagggatgaagtttagaggagctcaatgaagaacagtcgctttgagcttcctcggagaacttcctctttatgctctgtgttaagtggccctcatgtatggggcattcgcccgataacgtcttggcggaatttgttttcctaacttgcgacatgaccgagcttaaggacggggtcatcaaagatgagcgattttcgttcagcagttcggaatcgtctcgagccttcagtattctagtcctcttgaagctattcctcttggttagtgttctagtacgttcagcgcttccttgaccatcgaactgcggcttagtggagtggaaataaatctcatcgctcaccgtcctattacttgtggcggtcttgttcatgctggcgctggctaacttgttattcttcttattagtagcggtagcgtaaaatgacttgggataaaatacctttgatgagtcgctccatgagtgcaatgcgccatcatcacgtatgcttttgatgaggcaatgttcatgcacatgagcatcgtgcattagtgtgtgatttgtgttcacgtccagcagcattctataattatgtcttgttgaaagtgttctgtatgttcgtgtctatccaaagaaacaagtaattgagaaaactagccatcaaatacttgtgaagaagcgagtttccattctctgtttcactcgtttggcgttctcaccatcccacttttatttcattggcttttttaacacaataaggcgccttcagcacctttgccgcgcattaaggatggccactgacgaaaaaccggataaaaaaagacgaaaaaatgccgtctgaccctagtcaggagccgcctcatacaccctaattattttggcgctaagccctaagcatcattattacccgacatgaagcgacagaagccctacggatgtgcggctggaaaagaaagtttcatgaagaaccagttgatatatattttactatatacttttgctgtgtatttctatatgaggctagttggttggtgggaactggaagtgaaagttctgttctttagggtgcagcggttgctgttgctgttgctgttgctgttgctgctgtggttggattgatgcttgtgatgtttgtggtgcctgtggtgcttgtggtacagttttgctgccagtttgctgcgagtatgtaattatggggtgagcggcatttacattaggtgctggattgatggctggatttgttttttcgtaagcggcgatactaggcgttgtgctacttgacatgtttgcaaatgcattattaaacactggaggtgagacagactcggttagttcccttttctttgcaagctcttcgagccttttcttttcttccttcattttttttcttctttcacggtcttcctgttgttttctttgtttggcccttattattttcaattcaggcacaaaaatgttgcgcagctcaagttccaagtccctgatgcaccaagcgcagataaaagtggagcattcagacagcggtttgcgtttatcagtaggtcttgaagacttggtgctgggttcaagtgtggattggggtctgcgagaagaccttctattgccgtgcgaatttcccattatgatgacgccaaaatcacgttgcgacagcgtgtgctgtggggattttgtggttgaagatataagctctataatttttggaggttggcattcccaatgctgccacctgtaacaatgatcacagcatatcaatgggcggttattgaagaggtcagtctccgtgtcttcggtgataatcatgggcgccagctctggttcgcccggacattggaaaacagaatcttggttgtcgggctcttgctgcggagtaaagatcccgtagttggcaagctcatctagctcttcctttgttatgcagaagtcactaggcaattcagggacgtctcccgtctgtagtggcccaacagttccaggaattggtggttccaccgggattatactagattgaaagttagggccgtgatcaagaactccgatatcgatttcatttaagggattgtcctcctccctgcccaaagacgtttcaaaaaacggtgtaccagaaccacttctatctttgagctcgttacgcctggtcaatttttcatctctataatcttgatcgtacaattgccacaattggttccaaagaagatcttttatctttttgatttccttcgacactagcttgtttctgtgccttataaattgttctctttcatctagtttttcaaaccactcactttccaagtcttttttcttgttttcttcctctttcgctaccagtctcgaagatcttttcctccttgtcattagctccgcaattgctctctccttttctctgttggccaaaagttttgccgaatatagtctatgttcggcatacaccggtattaagttagttatgaactcatctatggctttcgaacttttattctctgaccagtattctagcatggacccccaattagttgtaatcacatcataatcaattgtaatcgattgaagatatgcatcgatatcgtgagagtactcgagatgaataagctccactgaatcaggaatgtctgggtcgctttcttttatagtacagttctgtagttttattgggatattcagagtttgagagacttgggaggaagagccttcttttactctgtgaatggttttctttacgagtacaccaacattgggtaaggcaaacaagctcttcatttcctcccctccactattatcatcatccagtataacttcactaaacgtaaacagatgcaagttattcgctaagtagtttttgaagatcatatttttcatttcaattaattttatgatactgtaaatgatgtcgaattggcgtgcaatttcaagctccaaaaaaggtaagtccgtaaccaaatctgaatacgcgctcgagttttgcaagtgatggttaactataacattccaatctttcaattgcccgcttttatttcccgctaattgatgcaataattgcaatctaattctgtcgtacaaattttgcgatccttcatctacgtcgacttcatcattgtaatagttcgagtccttcccgtctatcttcgaaaatacgtcagttacaaatacaccttcatcgaatttgatattcttccacaagcatttggtagagctaccgccatactggtcagtattaaatgtcgttgtagtatatgattcgcagacattggaaagccaagccatcacatactggaagtgccagtgattggccaagtccgcgatcttctcatctaatatttcagaatacggcagctggtgcttgttcaattgggctattatgtcttcggagacatattctttccagtcttcactatccgcattcgcagcgccggcaggcatgctcgctcctacatttcttgtacccctagttctcttcgttctcatcgatcgctgattcaccgctttgtatctatatatgattagccagtgtgtatgagtaaaatagagcaattgatctagtttcttagtcgtgtcactattgaataaataaatgttaatgttgctggaaaggaagaattatgtcacttttgacgctctcgcattccgtgtgcggtgatagcggtaacttggtctagcaacgaaaatttaaaaaggttggaaaaggaaaagaagagctcaagtggacctagaagtcctgctttgccaccgtttaagcaaggaatagagcacgccgttgacacaaattcacagtcaaggacgggccacgagaactttattacaaaatatactgcattacacgaaattcagcggaactctgagcgcgaacagcattaggtaccgagaaacgcttttcaaaagaaatttctaaaagttttattgtgccattaatatcgcggctcaattgttaagtatttcactatgcctaatccgaatacagcagattacttggtgaatccaaatttcaggaccagtaagggcggatctttatcgccgacgccagaagctttcaacgacacgcgagttgctgcaccagccactcttcgcatgatgggcaagcaatctggaccaagaaatgaccagcaacaagcaccactgatgcctcctgcagatatcaaacagggcaaggaacaggcagctcagagacaaaatgatgcatcgaggcctaatggcgccgtggaattaaggcaatttcatagaagatctttgggagattgggagttccttgaaacggttggcgcaggctctatgggtaaagttaaattggtcaagcatcgtcaaacaaaggaaatttgtgtaataaagattgttaatagggcttccaaggcttatctccataaacagcactctttaccttccccaaagaatgagagtgagatattagaaagacaaaagcggttagaaaaagaaattgcgagggataaaaggactgttagggaagcctctttgggccaaatcctttaccatcctcatatctgtcgtttatttgaaatgtgcactatgtcaaaccatttttatatgctttttgaatacgtttccggtggacagctgttagattatattattcagcatggctcattaaaggaacaccatgcgaggaaatttgccagaggtatagctagtgcgctgcaatacttacatgccaataatattgttcatcgagatctgaaaattgagaatataatgatatctagttcaggtgaaattaagatcattgattttggtctttccaacatttttgattataggaaacaattacatacgttttgtggttccttgtactttgcagcaccagaactattaaaagcgcagccatacacaggacctgaggtagatatttggtcgtttggtattgttctttatgtcttggtctgcggtaaagtaccatttgatgatgagaactcaagcattttacatgaaaaaataaaaaaaggtaaagtagactatccttcacacttatccattgaagttatatctttattaaccaggatgattgttgtcgacccattaagaagagcaacattaaagaatgtcgttgagcatccatggatgaacagaggatacgattttaaggctccatcatatgttcctaatcgtgttccattaacccctgaaatgatagatagccaagttctgaaggaaatgtatcgcctagaatttattgacgatattgaagatacaagaagatcattgatccgattagtaactgaaaaggaatacatccaactttcccaagaatactgggacaaattatccaacgccaaggggttgagttcaagtttaaataataactacctaaattcaacggcacaacaaaccttaatacaaaatcatattacaagtaatccatcgcaaagtggttataatgaaccagatagtaattttgaagatcctactttagcatatcatccattactatcaatatatcacttggtttcagaaatggttgcacggaaattagcgaagttgcaaagaaggcaagcattggccctgcaagcgcaagctcagcaaaggcaacaacagcaacaagtagcacttggcactaaggtcgccttaaataataactccccggatattatgaccaaaatgaggagccctcagaaagaagtagtacctaatcctggtatttttcaagtgccggcaattggaacatcgggaacctcaaacaacactaatacctcaaacaaacctccactgcatgtaatggttcctcctaaactaacaataccggaacaagcgcatacttctccaacatctaggaagagttccgacattcatacggaattaaatggtgttttgaaatcaacaccagtccccgtgtctggcgaatatcagcaacgttctgcttcacccgtagtaggtgaacatcaggaaaagaatacaataggcggcatattcagaagaatatcacaaagtggacaatctcagcatcccacacggcaacaggaacctcttccagaaagagaacctccaacatatatgtcaaaatcaaatgaaatttccatcaaagtaccgaaaagccatagtcgtactatatcagattatattcctagcgctagaagatatccatcttacgtgccaaattctgttgatgtaaaacagaaacccgctaaaaacactaccatagcacctcctataaggtcagtatcacaaaagcaaaacagtgatcttccagctttacctcagaacgccgaactaattgttcaaaaacaacggcaaaaactattacaggaaaatctcgacaaattacaaattaatgataatgataacaacaatgtgaacgctgtagtcgatggtatcaataatgataatagtgaccattatctctccgttccgaagggtcgtaagttacatcctagtgcaagggctaaatcggtggggcatgctcgtcgtgaatctttgaaatttactaggccgcctataccagcagcccttccgccatcagatatgacaaacgataacggctttttgggagaggcaaacaaggagagatacaatcctgttagcagtaacttttcgaccgttcctgaagattctaccacatacagtaacgatactaacaatagactgacttcggtgtattctcaggagcttactgagaagcaaattttggaggaagcttcaaaggcaccccccgggtctatgccatcaattgattatccaaagtcaatgtttttgaagggttttttctctgtacaaacaacctcctctaaaccattgcctattgttcgtcacaatatcatatctgttttaacaagaatgaatattgatttcaaagaagtgaaaggcgggttcatatgtgtccaacaaaggccatctattgagactgcagctgtccctgttataaccactactggcgttggtttggattccggaaaggcgatggatctgcaaaatagtttagacagtcaattatcatccagttaccatagtacagcgtcctcagcatcaagaaatagttcgataaaacgccaaggttcttataagaggggccagaataatataccactaacacctttagcgaccaatacacatcaaagaaattcatctatcccaatgtctccaaactacggaaaccaaagtaatggtacatcaggggaactatcttccatgtcattagattatgttcaacaacaggatgatattttaacaacatcaagagcccagaatataaataacgtaaatggtcaaacagagcaaaccaatacttctggtataaaagaaaggcctcctattaaatttgagattcacattgtaaaggttcgtatcgtcggcctagcaggtgtacatttcaaaaaggtttctggtaatacgtggctatataaagaattggcatcgtatattttaaaagaattaaacctatagatacgttgttcttactaaatatttcaacgtgtgtctttcaatttttattatctaatatttatctttttttaatattatagtataatttatttaagctgagatctgctttctttaatctttcatatgatgaaataatagttctacataaatctataagaataataaataaagtaaaacaactgcaaaaaacatcgatgtcatccaggatccttgaaagatttcactctggagaagaaaaaagatttctcatttctcaacgaacagttagatgcattcccttccttatccactacaattgaacttagccatttcaaccgttgatatctcttattgccttgattcttgatttggaattcttcgataaacgtatacttttcatctgaccttgttatctttaaatgaccaaaatcataatcaaatccgaggctccaataacacatatgactatgcctgggtttgttctctttggagaagtgcttcacgacagcgctaggttcatctgtagaaagtaatctcaaacattggccgttctcataaaatctgaaatacctgtaataggtgatcatgtgaactggctttaaaagagataacgaactttctgcattggaaccgtatcttacataatttactacactgatgtaaacaccttcgaatttaatatatggcctttcccttaacatacgataatcatcaccccgccatatttccttttcaaaggtatttatatcggtgattccgttaagatccattgccattttgtcgtatatttgcttagaatatatgtacttcgcgaaagttttaaatggcacagaatcgtggaagcaaagcttgctaaaggtggaacaagtcatcgacaaattcacccaagattcaccagacattaatattacttttttaataattctcagtaaaatgtcgtcaggcaagatttccagaatccaacagggttgaagttcagcattttcttcagcagataagtcatctttaccggtttcattttgttcatctggagcatcagtagtcattgataatcccgatagttttttgtgcagcatccactcatcaagtattttttttctgtacagtgattccacattatcatggattttcaatgcacttcgatagaagtttatagcatctgacattgacccatccttctctttcagtacacctttttcccaaatagcaatagcctctttagccctagggtccttttcataatctactatcatttgctccttgagtttagcttatggaacacatgtgtcgtcgccaaagatgatggggaatgtttgcttttatcttgctcagtcgatttcgctatctaggaactacaatccttttttttgtcatttggaaggctctttaaaattccgaatcgataagttcggaggtgggaaaggatagcggtatattccttcccaaataaaaaggctacaaacacattacataaagaatatttgttcaagtaaacatatcctcttcactcaagattacttcgacaaaccatcattggtgtttccaccaatcagcatatcaatctcattcaataaagtaaagtcaaaattgtactctaaggcaaaatcgttaccgtgagatagagtccctaataaatccatagtttctgaattatgcaaagcatcttcagagttttctatgaattttctagcaagttcgtaattcagggtaggcgcacttaaaaaatttaagaagtcttgttttctatcctttttaatcaagttggacttcatgcattggatggctaaaatcgcagaataaatcatgtaaattgtggccttctcaaacgtcttaaatttatttttccaaacttttaaaagataatacagttcatcaacataaccttcaaccaattcccggctttgtttgatttcgtatatgaaaggtttattataggaaattagcacgatatagtaatgaaaccatacgtaagctatggttgggttaaaatctgtcatttccatcaatgacctcttggtccattgtagttcagggggcaaatcccttctccaattgtatacctccagattaaatttggccaagtattcactcctttgaagtagagtttcgtttgggctgaaaatcttggatgcaaaaatctccgttattctcgataacacaatcagtttcttcaaggggtttgcagtggacaatattacttttgggtcatatatgtactcctctataccagtctcaatttcaggtagctcatctgtttctggaacagtggaattggacaaacgtaaggaagttgatcttccaaagaggatcgctattaaatgatcagcaatgtagcagccccaataaattctacttctcacttcaaaatccattattgacagctcgtcttcataaacattactccatgcttctggattcaaatgtaggccgatttcgtgggcaatcctaaatgccagcccagaaagataccaagccatggggttttctccgcttccaatgtcataaaatgccaaacacaatagagtctggatgattgctaatttcgaagaggacgacgattcagctaacgaagaatcttccagttgaaaaatttttttgagtactatcgtcttggctctttgataaaacacttcagattgttgaaaaagctcagtttctgatttgtatgaaatcaaagatcccaatgcagcgattgcaaataccaattcttcggaacaatagtaacttttagtgttagtatcaccgaagaaagcacttaagaaagtttctctatgaatgaaaaggtaatgtcccgggtatagccatttgaaaaagagtgacaacgatcttaagataaggggacttcttgataaattttttaggctgacctgctgttgctggtatcttgtgcttccatccgtcttcttttttattatagacaaggaatttgatggatatatactatttgtgccaactggtggagggctctcggaaggcattttcttggtgaacgcatcagactcattctcatcgttgctttcagatgatggtagtgctgattgtgctgtttcgccatactttaagattttttcattaggagcatcaccatgatcactgttgttttttaacgaggagagagcattgctagcaattgtggaagacgaggaacttaatatttgcaactgttctttcaaagaccgaatctggctctgtaaagcttctacgtaagtcgtagaatatcttttgttccttaagtcttgttgagtgaatacacattcggtacgaaacttgatacagtttgaacaaggcttttccatgttacatttccttcttcttctacggcaattctggcatgctagttttctcttcctgggcacgttgttattattctggtcattatctgtcacagatttctttaaactggacggaagggagggtgttaccgttgttgttaaaggtggaggtgaaggctccaacatcattgctgcgattgtgtagagcttcgagttttaaaagggctatttttgaaaacttacggcgatgtcaacttgttgattttgctttgtttcgttcgggatggatcggaacatccgctcacatatgagaggtttacactcttgatgtatatgttgctctatcttgtatacggttaagtaaagtgatgtattatgtatatgtatgtatttatatatatatatatatatatgcgtggttttccatattgtannnnnnnnnnnnnnnnnnnnnnnncttctctactctatataggcattactttgacaggaacgagactaaagaagaggcaaagtgctgcgggttgtccaggaaaagattatggccagcatcagggacttcaacgtagctagcctttgccttgttttttagcattgattcagtagtcaagtagcccgcatatttatccatccaatcgtgctcgccatacatgaacatgacaggcgttgctgggttcaaaaaacgaacgttgtttattatcggatctctagcgatcagattcctttcaaacaaatgggtgaacaccttgattgtctgtggttgcaccgtctggttcttcccgacaaatgagtgcaaaagatagtccttatatatctgatccggaacttttacgtatgcggtggagatgtagttcgagcacaatttggagcctatgggtcccatccacttcaaaacgtttagctggttttcaaagataaaccgcggtacgttcagctttcttgtataatatcgggacgatgggtcggtaaacgtaagtggataggtggtgttgggctcccatttgtgggtgatagcatgtatactgttttccacaccaagaggagatatgagacacagtttctcaatggaatcagggtacttgagggcgtatttgaatgaaatatatcctccgaatgaatggcccaccacgtttattttgcgaagcttgttatccttccgccattgctctatcctgtctacgaagtagctttcgtactgctccaggtgtgacttgatgtcctctgctggggggcgcttctctatcacagggattactacgtcatcttctatatgcttaaacctgagagacttgatcttcttggttttgttcacttgcaatgctggcgcctctgaggcaccattggctggcaagtcgatggcatatagatctttaatgttgtctgacaggttctcaaacgtcctgtagaacgccatcgacgaggcagcgtatccatggattagtactgtaggcgtgcacactttgttcgcacgcttattgtggaaatgccactggttaatcccgcctggagtcatcgtgttattaacggacccacgcacagtggtgctatccataatttgctgctgcagggccttcaggccctgcacgctagcacacaccttggcgtctgcagtagtggtctccttctcagttttgctgcaccatttgaaagtgtttgtccacattctactgaagaaaactacgcttacgtatgtatatgtcctgaacaatgagagaaagacctgcgaatatacttctactactccacgtacaaaaaagagcacgctgctttatttatacttttgtgccacaagaatgatcaacatcaacataaatatcaactagtatctgcaacacatctgctccacggaactaaacccgttgagcagtgccccgtggaaacgtaaactatcgcaaattgggattaacaagccaaaaacagccaagcaagattcacgaaaccgcgcctcgtttggaccccgaaggcccatttaacggccggccgttacaagcaagatcggcagagcaaaccactccccagcaccacagcacatcactgcacgagcaacaataactagaacatggcagatagcgaggatacctctgtgatcctgcagggcatcgacacaatcaacagcgtggagggcctggaagaagatggttacctcagcgacgaggacacgtcactcagcaacgagctcgcagatgcacagcgtcaatgggaagagtcgctgcaacagttgaacaagctgctcaactgggtcctgctgcccctgctgggcaagtatataggtaggagaatggccaagactctatggagtaggttcattgaacactttgtataagtgtttgttgtttatgtatccgcatatagcagttataacagataaatggcacttttcgcacacccgttgttttatctccgatagtacgtgggcctttatatatggtcgtttaacgaaagaacggcatcttgaattgagcaggtatttaaaagataggacgagaaacaagcacatgatctgtgtcgaaaaaaagtagcaaagagaaaaagtaggaggataggatgaacaggaaagtagctatcgtaacgggtactaatagtaatcttggtctgaacattgtgttccgtctgattgaaactgaggacaccaatgtcagattgaccattgtggtgacttctagaacgcttcctcgagtgcaggaggtgattaaccagattaaagatttttacaacaaatcaggccgtgtagaggatttggaaatagactttgattatctgttggtggacttcaccaacatggtgagtgtcttgaacgcatattacgacatcaacaaaaagtacagggcgataaactaccttttcgtgaatgctgcgcaaggtatctttgacggtatagattggatcggagcggtcaaggaggttttcaccaatccattggaggcagtgacaaatccgacatacaagatacaactggtgggcgtcaagtctaaagatgacatggggcttattttccaggccaatgtgtttggtccgtactactttatcagtaaaattctgcctcaattgaccaggggaaaggcttatattgtttggatttcgagtattatgtccgatcctaagtatctttcgttgaacgatattgaactactaaagacaaatgcctcttatgagggctccaagcgtttagttgatttactgcatttggccacctacaaagacttgaaaaagctgggcataaatcagtatgtagttcaaccgggcatatttacaagccattccttctccgaatatttgaattttttcacctatttcggcatgctatgcttgttctatttggccaggctgttggggtctccatggcacaatattgatggttataaagctgccaatgccccagtatacgtaactagattggccaatccaaactttgagaaacaagacgtaaaatacggttctgctacctctagggatggtatgccatatatcaagacgcaggaaatagaccctactggaatgtctgatgtcttcgcttatatacagaagaagaaactggaatgggacgagaaactgaaagatcaaattgttgaaactagaacccccatttaatatatctctgcgtacatatgtatatatatatatgtgtgtatatacatgtatgtctgtatagaaaacgcatatcaactgatatatatacacgtgaagcaaaaaaggcattgcctctgtcagagaaacgaactatcctcgttgctatagtgtcttctgcacttatcgcgtagactttctattggcactctgtcatggcatttaatcttgtacacattctttaattcttcttgcaaaagaaggtactcttcatgcaaatgatgactttggagtgaattgactaatcctgagtcgttccagaaactttttaaggcgttcgtttcatgatttattatgtcatccaaccgtctcatattaggtttcgaatttgttacaaattctcgccttgataacctctccaggtcttctttgttgcatccaggtacactctctaacaacattgaaccattgccctccggattcgcactgtcatatttattagcctcttcgccgcacatgatgtcaatatcgggtcgatagctgtctatgccgtctagatggcccaccttatgaaacacaagacaatgtgctgccctttcggctttcaaaaaactgtcaattctactttcccttagcgtattgcgctcacaaaacggtgaataatcgtattgcttttcttcctcgatgtggctcaaagtattcagatagtcgacttcgtctacgtccatatttatcccatagagatcatctgcagtcctctcctctagtacttcgcctgttatgggcatcgaatcatcatttattacccttgtcgaccttttccgtagcggtgtggtaaaattgttaaagttggctttgttgaaccttggtgttttccagggcggcaatgacggtagttgaaacaacttgccttcgttcttatcaccattttggttcatcttactttgtcacagctatttctttccttcctgaatttgtccttccaaacctagttccctgttcttaatttccttttatttaggtttttttttttgttttgtcaagagccgcgcacaaaatatggtattattatagaaaagttggacttaaaagcttgaaaaagcttagattttatattcatatgctggtatatatgtacgactaaataatataaatttgattataacaatccactcaaggtcagcttctccaggaatggtgaaagatcttcacgacgtatttcaattatggaactttcaaaattatctattctcactttagcatccgtttctgcagttatttgttgaaacgccatgctgaaattattcaaaataggtttttttgtgtgtatcgtgtctagtccgcgaggatacctaggtgttaacccagcaaccaagtaagtgtccgtattttcatctatgctggcaagcaccatgggcaacaattgcttgtcttcagattccgcacagcattctatgagccaatttcctaatcttaataacgtcaatgggtttctgtacaagtctaaatcgggtccgtcttgtaagacgcataatctataaattcttaaatgcttgattaatttcttctccaatatagcaaccccggtattaaaaattgctctctgtaagtcttgtgctagttgaatgccacggtttaatagttccacctttctgtcatctagagcatcccaactgagccaaaaattcgaaacccatctttttctcaaattcgtcaatttttgagcgctgttatcttcttcttcctctccatctgtatcgtcattattgtcattatttattttcacactatccttatcagttgaattacctacttccaaaagagctgttagtgcttcgacaaattcactggcacttatggacccacgatatccaagagttctaacaaacccatctctaattatatcttgcaacccataacgatccaaatttttgtcaaatattatcccaagttctctcttaatagaatgatccatgtataaccatgtttcttgtgcagtacttaatggtatacccattctagcaaacatcttatgcaatctctttttcccattttcattccatagggatagtttggcattgacatagttagaataataaaaactgtcgtacaatgaagaatgcctcagtaagaaaaggtagtaatccggttggatgtttaacgtcaatgtatcaggggtctttactgagtttctactgcttggtgtgagacgcttcacttcatcttgcaataaggggtataatcgattgtaaacttgagcatatgctatatctaacgaggtcgtaccaagtatattcaaccacaggtttgaaagatttgtttctccgatagcagacaataatgaatagatttgtgcagatatcgagttaaccactgttgtgccttgagaatagtattcctccaaaacaccttcatattcatggatttgcttctttcgttgctttctttttgagagatcattcggtcctattgaagaattacctcttttattagatattgtctcatcttcgtcttcttcgtcctcgtctgtgacttcatcggcatcagttgcctcatcgtcacccccattattatcgttctcgtcacctgagagctcatcgtcaccactctcctcgtccagttcaagcaatttatagtatgcttctttttgttcgcctaatgtgtcatccaccgtaccgtcgtcaaaacattggatgatttgtgatccaaatatattgtcgagattccacggtctatgagcatccaacacgtagatgtctctcctgaaactttgttcccccgacttttcatctgtatcgataacatactcttggggatcgatttctaagaaagcctccagatcaataacgcctccaaaccctactaatagcagactatttatattgtcatccaattgagaatagtggcgtcgtaattcagagtacccaaatatcggtactatttgagattgtaccaattgttttttgaataatagtgacaacatcttcgtcgcacacagcgcatcgatgttaagacaagaaacgaaaatgaccaattgacatgatgaatgagacgatgaattccttaagattttgttgtaggcttcgctaaactggctgattccataatacatgtgcgagagtatattcttgttattatgtgccttctctctagtgtttattgctacacttttattgctctatagtgcgttgtataaagtagccacaatggattgttggcattactacagcttcattatttactgaaatttcttaaaacgcgttagatgatatgttgaaaaaaaaatacgcgtcgtgaatgaaacttattaggttttacgactagttaaagcaagagagagaagatcgaattgactaaatgtcttcactttgaatttattctagtaggattcgcatggctttttcataataaaaatctcgtttatttatgcttttggttggttttcctttgataaatgcggcccttgctttgtttgtggttgcaacgagttcgtcaaatgataaattgacgcttaacacagacgcatgggaaccacgtaattgaattaatgttttcttctcgaaacaattgcaatgtgactttcttgttaggcaatgtgagatgaaagatggcctttacctttgcagatgtttgggtgtggctctgagctgtcctttataattatagagataattttgatgaaagctcagaagacctttaatgacgaaaaataggcatggtttgccaggcaaaaaacgaccaaattttactgtagtatgagtcaaagtcgctggagtatcgttctcatctttgcattgtttatttttggcagcactggagtgaatgccttcttcaatttcggtcatcatcagcaacagcaacagcaacagcaacaatcatatgaagatcaagttttaaataacccttgtgatgggtatttgtgtccggacaccctaacgtgcgttgcacagcagaaagactgtccttgtcccttccctaaatctcagttgaaatgtgtccttcctgataataaatttgtttgcatatccaaaccagccacacacaatgaaaagtttagagcaatatatgatgaccctgtcaagggccccaaagcaaagaacaaggggtttagggattgtggatgggtatcagatgcttacaaaaaccattgaaatctgtataaaaaatacatacacatacatatatacatacgaaggatttatcttctcattgatattctagtctctatttcttccgggaacccatctcttatacaatacttcaccaacttgaaaactattgaacaatttagtaaagttgtttgatttccatagtgctatcgcctcctgttccgagattagtctctccacgtagcataacacaaacgtcttctttgcgccgcccacaacacgggctatgctagaataccacgtataatctttagagacgtcgtggtcaagacccataacacaaaattcagcgtgttgaaatggtggccctctcttatataataaataatcgcagccgaattttataccagatcttacgcaccaaccgtgtgatctgtagtgatggtatataacgtatgatctgacaaaggagtgaatatctttatatttggcatcgaattgaaacagtttccctgccaggcacgcgggagatatgtcaagaacaggaagtgcaaaagttaaaaacatagcttccactggcattagttctagtgactctagtggcaaaagatcaccgttctcatcaagaagattgttgtcttcatctcttaaatttgattcggaaatgtcttgctgttgtgcaacgatgcccacgtcttctgtttgttttagtttaaattttcttaatgattctcgttgtttctcaaggaggatgttttcctcatcgatatgaccacctttttttcttaattctagtaattctctttctaacttcgcacgttctttcttgaactctaatctttgtaatctcctctgttgtgtgaccttctctaaagtcatctccgtttcagtattactctttgttcctccccgattgtggaggggagtatcattgagacccagtctggcctctgttctagctttccatgtaggctcactcctgctaaattgaccagtgccaaaaaatccattattccaaagatatagcatttgcttgtcatcttgaaccgtgatgtgaagagtggtatctcctataaaatctacatgtactttatcgttcagtgcgttcgtactcttgtaatagcggtatgcccaatatagccaagataacggattatgaaggattaactctggaaggtcatctacggggtgaattggaagaggatacttgtaacgcttctgattgaccctccctttagacatgctccttcttgagtccttcgtacttattgtcttttcagcgtcgtgttacaatgaaacgttttagcatattgaatttcgatggaagttcaaatgttttatgcaccgaaatgaaatactagagcaaagagatgttagtgaaagcaccagctaatatagctctttcaaatttacgtgaaaaagttatgtgtggcaatataaatctatagcaagagtggcttctataaaacatttttgacaagaaataaaattcagataccgttgtagtcttgagaaatcattgtgctcacatcgattaacttcgagcaacataaatcatgctatcatcattaaaataaagtggaagtattaagaacagatataatagcacgagaaaaaactcgttcaactaagtctagacacacctcctggtgttatttagtccgttctcttaacaaccaaagcctacgagctctcaaacagctcttttgttttaacttcctatagaactgaatgggaaacttgcatcttgaagaaaatttttctctttaaatatctgactgaagtattgatcccttcaaaaaaaaaaaaagagagttggttacccatatgggaataatatttcttagggctaattgacaaaggattgctaacagaaaatgcaaaggactaataacttgaatcatttttatatcaggtttatataggtatacgttcagtctaattaataatttatagtttacagtagttttttacagtagttttttttttttttttcagttccatgatttttttgttcctttgattcgtgtagtaaacctcctcttcttggttttcacgatatacttagctggatgccaggtctgtaaagtattgacgcaaaatcagtgaaagcatttcgggtagttcgcttatatcgtgtacaacaacataaaattcaaaaggaaatgtgtccaagtatttggtaatctttaattgcggattgccatactgatctggaatgtagttcacttggctcatgtctaagatggattcattagaagtaataccatctatgatgacaaaaaccagcataattttgttttctctagcacggcggaccagtttttgtattgtttcatggtcttcgcaaataccatcagagattacaatttctagttgccattggtcattatgtaccatagcgcgagcacgttcaaaaattttagtagattcagccacaagtttcttaacgtctgttttagtttcttggaaaccaaaccattgaaaagctcttgcgccagattcgttactaaattgttggtcaaatgagtgaacttctttaatattttcaccgaatttgacaatagataaccctccagcctctagctgagttaacgtcttggagaccaagcataaactatcaaaagcgagtttaacgcatttagattcgctcatagacttagaatcatcaagcgcaatcattatttgatactgacgtttgcttggtttagttcttctcaaccagattttatctttacggaattgtgaggcaatatatggaatgatccgtttcatattcagtctcttacctgttttgtaatcacccttcagctttgtagccaaggtaggttccaagattagtcttaattgttctccaagacgtgatactaaatcggcggtcgaaatttcacttttatgccacaattcacgggattcttctaacgatctttccggtgtcaaactagcacttgcatcaggtggattatcctcaatgttttcaattaaagattgtatttcactgtcatcctcttgatcagccgagaagtgttcatttgaaagttcgttctcaaaatcttcctcactctttcttttaccgatgaatcctgactttttgctgtcaacgtcattgttagcgtcatgcgcgtcgatatcagatagcatctcttcttcatcaatatccattttttcatcatcggcgtcttctactaactctttctggtccacttcttgctcctccctatcatcatcaatggccatgtcttcatcaatggtttgtaattgatcctgtgttgcagaacctaaagcttgcgtatctgtttcagtatttgcaccctcaacatgttcaaattcatcgggacgttcattgtttttttccaaattttcgtcctcttcgccattagtttgtgcttcttttatatcttgacgacgtctatgatattctttcatgctatcacctagttgctttaaagcagccgtagcctcttcgcgtgattcttcattattctttgtcacatcttcttgatcttcttcataggtattctgagtcgttcctgaacctccaacatcgtcctgttcttgtgtgtccgtagcatcagcaccagcacctttggatccagaatcttgttgaacggcagcttcttgatcgatgtcttcagtatcagccttttcctcaacgccatcaagaccttctgtattctgctcacctcctttctctttgttttcttccatagcagcatcttgctttaactcttcttcatcagacatggcttgctcttctgggccattttcttcgtcttcctttccctcatcattagtcatatccacatcctcttcagcaccttcttcttcgtcaagagctgtttctgtctcgccggcatcttcctcaggaccaggttcgtcgttttcattatcactttcgataccggattcttgtttgacttcttcgtcttcgtttccaacctcttccttgtttaggtcatcaggcattccatctgacatatcaacatcttcgtctgattcttcatgctctgaatctaaattcatatcttcaggaaggtctagggtttcgatttcaggaacattagcctccaaatcctcgccttcttcatctttaacttcgtcctcctgttcaccaacgtcgttttcctcttctgcattttcatcgttttcaatttcctcatcgccatcttcaggtgcatttgggtcctcatcccctccttccttgttatcccgctgttgttcgtcattttcagcagcttgtacatcttcctcttgattttttccatctaaattctggtctgtatctttttcttttgaattatcacttgccttatcatcccacattttatcatcaatagcgttggggtcatcttcattcaggtcatcaatttcttcatctaattcttcttcttcgctatcagtatcttcatcatcattttcttcaccattagacaaatcttccaattcaccagccatatcgccctccatctcaactgcatcatcttcattctcgtcatccctctcatctttatcttgttgttctttgttttcgttttgtgcatcctcagtcaaatcttcgtcttgttcgacgtctttattgttattttgagcaccttcaccgtctcccaagcctgtaccctcttgcaagtttttgtcgtcaacttcttcagatggtggctgcggagaacagaacccatttttggctaagctatgcaatatcgtcgatagaatgtacataccacgacttgtgttcgtgtagtagattctagatctttcaagaaccacggtcattgcgttgtaataacgtgtgattaccggtagtgtaaaggatataactgatttaacgtaaattgattcagtagtggtaaaatcaaagtccttcaacaaggataatgctgtctctatatttttagaaacaacactggatcgtaatagtttaacgtttaccataactttcttgaagctagctgataaccagttatcatcagtttcggatatagattcaattccatctccaattaccttctggaaagataatataatagatgtgaaagtacggcggaaagcctgttcaacatcttccaccgaagggcctctcttctgttcctttttaataggaccccctttatttgctttgatccactctataatgatatcaaaaacgaaagcgttccctgtctcctttgcattttcaagcttcttcaataattcattaatgaataactcaaatctagaatatgactcgataaatgaagaatcaaaaattcgactggaattgaagtgtacgaaaaacgaagataaggtcgattttgcatctaacaagatcttttgttgttctgaagttgctgagtatttcgaaataacagacaaggtctgtgcggcatagtctaacaaagaaggcagccacttttcaaacaatctgacattatctacattcgcttttaatgaagaatgaacaatatcgccctttaagcaagtaaagtgttctaggtctaacatcataccattaatcttacagtaatcattcgtgaactctgatagagggtgacgaactgtaatcagggaaaacatcaaactctgtgcgagtgccatacctctttctatagcagcaacagggatatcatcacttggattcgatgcagcgcttctcagcttgggtaaaaggtcaaggattttgaaaaagaatgcgtctgacgaatttaaatattcattattgaaaggggcaatgtttgccaaaatagttgttgtagaagattgaactttttgaatgtcttccctaaaattgacttttaaaccgattcttctcaattctttcaatgcatcacctaaaagtttacttttttgagtcttcaagtatgccaacctctttttgttctcctttgtatatacattaggggtttccttacgtaacctttcagcttcagcataaaagtccgatgctaaatctgcgaagttagggaattcctgtgatgatatcttttccaagtaggagtccatgttacttgctaccgtgtcaatattccttaatggcgcagctctcatactccaagtagaaatttctttcaccaaatttttcgaagcctctaagttggggtcttcgtaaaaatgttgttttaaagtagggagttttagtttattttcgttggaatacaaaagaccggcctcaataatggttttcgcatccccatttagcaaatcacggtattttctgacaattttgtaaaggttgttatgagacttacgagaactttgtttcagggcatcaacgttaacatctttccaactggctaaaagaattatatcgtcaatttctttttccagactcttttttccattcgtaatccgctcatcaattaatggtttgaactgataatagaattttatagtattatggagcaagcccgctatcttcgagctcctcaatccaattagttgaatgtgcttgtagaatgcttttacaagatctagcctggcgttgaattcgcccaatgtactcttactaaaaaataagttaagtgagcttaccaaaagtgtagcgttaggggccgtttccttcttttcactaacaaaatttgaaatgacaattgactcgtacaaataaaaccaccattttccaatagattttctggtttttgcgtcttccgagttgaaaagacctttccaggtgcgtaattctagttttctccatgaaactatcaaatctgtaatcagtttaacggtgttattcagggatacttccgaggaagcgtatttttcccattcagctaggtatgtatatatttgttcgatcttttgaagctgtcttgctaagggtgttttaatggggtagtttaaaaattcttgggaaactcgatataattctttgagggtggcatgttctggccactgcttcaacaatttcaagactgacttaagcacagtttcaatgatatcacctgctttttgaaactccggaatagagaaatcgtggtaaaaatcgatattaccaaaaacttccgtgtttttgaaagattgtgtttctgcatcaagtgtattaatcacagcagacaacgatccgcttttcaactcttctatcctggtgttttttaaatcttcactcaaaattgttgttattatcgcaccgctcttcaactcagaagaaaagttggcgtcatgatctttgtcaaataccgagatatatgtgtcggcaagcttgaaatagatgtcatcaagattttcaggactcgaaatatctttttcattagttaccaaagctgtgtcctcataatctggaaacagctttctaaagtctgcctcgtaatcatctgaattatcattgaatttgaacatatttgacttttcgttttcctcctgctcctgtctgaaacgtctcacagaccatcttgaatacagagtatacaaagcagcctcaaaaatttccagtaaatttgtatccctcttatggaacttaaacagcgtcaagaagtacatcaaaaccttttcaatcgaagtatcttccatatcaccctttttgaagaaccttgacagctcatgataagcgcttaaaacattctctgcgcatgaaatattgatagggtccatactccataaaggagaaatttggaatgatgctctatccttagatttttgaagcttcaataaatcaaagccaaagttgatactgtaaatatatcccgcgaggatatcatttaaatcagcaaattttgaataaccgctttcgagacgattcaaaaaatgtgcactattttgttggagcatttctaatctacgatccgattgatctgaattgcacttgtaggaactcactagctcttttatttgacgagaactcatagttgacgacaaaaatgccatccattcatcaaataaagagtcaatagacatgcctgtacgatataccctaggggattgaggtgcgtcgtcatcgcttatggtattgataagtttttctgtgaaaatctcctcatcgccactgattactttacgaacatttctccaacttttcattaggttttgagaaaatgtctttgtcttcaaaaataaatcatataaaacgtaatcgtgtattgccggatcatagggagaatctgggacgaatagcagaagcaaacctgtaccaaatgtgatccaagcttctcccagttcttctaatgatttcgaactttcagccaaatctagagcgggaaagatgtattctgcaaaagtcacgcgtgtctctgaagcagttttttcttctatgagagagcaaagttctttcaaagtcaatttcaagcagtccccgccgacgtgaatatcaataacttttctgagccatgacagtaacatatttttatagtactccatttggctctcaagtaggttaggtgaacacttgatagtggaggaaagtagcaattctgcgtcactaatagattgtttgatctgatttcccgaaaatgatttcaaattattagatttacgaacgacatcttcgagaaactgggatgaaaatatggtagaagtaaaggaagtcaatttagcatttttttctgtccaaagaacatcaaagataggcggataattgtatttgttggtaataagttttgtaagtttttgcgtggctaaagaagaagcgggagcaagttcttttattagctcggctgtgtcaactgagaaggtatatctgatcaaattgtcaaattcgtcagcaaaataatgttttcttttgtttaaaaacttatttgaaattagttccaattcatttataccatcttctaactttgatagcaagagattaaactcacttaatttattattcaacacatcatcatttagcaaccggaaaacgtccatcaaatccttaatggaattgtatgattcagaaaattggagcagacgtactttgtcaaatttttcagataaattaatgagcttttcgaaagctagccagctgttggaggttgtcggataattttttctgaatatatcccatagtaaagttatggagtggcccctcgacaactgtaaaacatcggtaaattccaaattgatgttaaggaagggagttatctcaatgtctgatttggattttacggacgcaatccagctatctatcaactccttatatactcttagacgtgcttcatcctttgtaacggcggtttctaatgctgcaattacaattaccagtaaatcccaataatattgatattggttggagccgcaaaataaactttccgtcttaaggttttcagacattactgttaaaatattgtagagaatacagaatattggaatgcgaggaatattcttcaaatggcgaccgttaaaggcagccgcagataattcaatatacgtcagttcgtcaattttaccatgagttgatttttcattgattaatttgagagcgttcaaagagttgagtagcagacgtaaacttgataataagtataacgactctggagatttgatcttatctgaatacttgctgactgttggaagaacatattcgttcaaggtaagcgagacagtttcctctgtcaattgcttatcatgcagccccaaagccttctggaattttaggtttgcaggtttgtataggttattaatcttttctaagacacccatatcagtcaaaaatgttataaaaacataaagcctttctgcgatctttttttctgagtactccgtgcaattcaatacattattggcccatttaccaacttcccctaaatgggaaatcggaataacagcagcaagagattcttcaattggttcttcgtcagataataataaaatatcatgtacttgtgcaaatatgcatggtctgcttaaataggatggaacatagtgttttaatggtatcgacatatcaggttcatttagttttatttttttgatgccatcatcaatagaaacaaagtctatattctctccaagttcaaagcctagggtgaggcgatcgaaggctgtagaacgactgtgcaattcgtcgatataaatctccacacctctgtttctcatagctcgggataattcaccatattttggatccatggtcaaaaataatctgaagttagggtggggtttgagaacccttggttggccatcttcttggctacattcattgatgagcagcgacccgtctatctccaatagagagttcagtctatcaagaacagaaggagaacaaagattagcattatctaagattagccaatggcccttttcaactgctttgaccaacatgccatcaaaccattcaaatttaaccgaagcttccttagtgatgatttcagtcattttttcaatattcatactcatagtttttaataggggatgcccttctaagtgcgaaaagaacctattaaaacgatttctgaaatcttggaatttctcaggtgtgacgatattattgagcaaatatttcaataagttcaaaccttccatgattgcggtagcatttggtgagagcttcatattcatcgagattatttctcttacgatatttgttaactcctcagtgatatatgatatttgtctagtcaaatcaacttgttcataaccaccaaggatatccatactatctatatcactattcatggaaaacacgtctactctgggacccaagattgaagctaaaaatcttatcgtttccgttttaccggagtttgagggcccaacaagtaccaacggccaattattgttgattgctttcaaaacagattcataaacggcgacattgcactctaatgggaaaagattctgggtaattggatagcggtaatggggatttcttagagctacctcgttgttaatttgaacatagtcttctgtaagtttgaaaaagttctctttagttgagaatttaccaaaaatatcttcaatgagaagctgtgctttattcttatcgctgatagtacggaacctctgcttaacgattatatcaacaaagtcaaacacgtccacatcttcgcaaatcgaatattggttgagtaactttagccaacgcaatgtatctctcaaattgaactcccatggtgaaccagaattaccccaaagttttcttttacagacttgatcctctaaagtagacattaacttaatcattttcgcgatgatatctggctcaatacttggatataagtgttttgcaatcaaaaggagatcatcagatgtaagcatgtcaataaataccacgctaaatcgattaacgaaagatttaggaagacctttcctaccaccaccttgatactgaggattttgagcagcaaagaccagaaaattggggtggcaggaaaacgatatgtccaactcggggatatacgcttcgcctcgatgatctaaacaggcattcaacccttctaggacggattgggaggctaaattcatttcatctaataaaacccactcacctttcttcattgctcttaaaaacggagcatcgtgccataaaaattcaccacttcgctcaccaggagcgtctgcaccgaaaagatctactagatccgtttgttcagacaaattgattcttgtaagcttatttcctgtaatattggcaagagcggtgattaaacttgttttaccaacacctggactaccttcaagtaaaattggcttgtgtacttgcatagcccgtacaacccttactaagtttgaggcagtagtgggggcggttaagttaaaggatgaagactgagcatctggaaatcttggtattttgaacattccgacttgtaattcatcctgagtcacaataatttcgttcgtttcaatttgttgtagttccaaatcgtcaccacatagtttcaatagttgtataatacattctgttctaagtgactttaaatcattttcgttttcagctaagtaagcagtgttatttgtaccaagggcgtcaataaaaaccattgaggcaccttgaattaaggcagttgacttgttctgtattttcggaaacactttattaataaattcaacccatgcaagtatgtcacgtaaagaaatgacaccacttgttgcatttccgcctcccagcttcttgccaaaccattcagagaatttcacaattggattagcaagatctttcaagtcctctaaaagccttgaggatacgatcatgtttacatcgttgaaatcttccatggatggtacccatatttcagtaaatctatttcttaacgctggagataattcttttttaccgtaatctccaccagggttcatggttgcgaagaattgaaagttttctgaagccgttacaaggctatcggatgaaccctgttctgctaacaacaaactcctttctggctccaaaacactatttagtctttcaagaacggaatcatctgctagcgatatttcatcaagtagaaaaaaatttcccgtcctcatagcttgaatcagaggcccgtcactccattcaaataaaacattcaaactatccctcagcttttgtatttccagttgaacatcttcggctatatttttattatctgacttagaatatagctgtaataactctttcaagtctacatcttggtcattagcaatattcaatgctgtttttaaggattttattagcttatattgaatttcagacctgttacgaacaggtctttgagcacctaatatgtctccagtttctgtgttttgatgggcatttagtgtgatcagttctcgacccatgaattgcgccaataattggcaaattgttgttttgccgcacccagtttcacctaccagtagtactggctccttattctttaaacaactagaaactaagacggatagtcggcgcattccttttgtccaagtaacagagccaatggcttctaaggatttatcttccagacttgcataatattggtccatatctaatttaactttcattactttttctaaagtctttttgactgtaactttttcttgtggagttctgcacctttctgcaagaagcatatagccactggcagcaagctgctcatatcccactgcgtcccttaaagcccagcggaaaagatcacgtagagttgcaaaactatttttctgttcgaacaaccttgaagcggaacgttcgatggataattggcggtatacttcaacgattttctttgcatatgatggggcaatttggcagcgctcacgtaggataatttctaattcatcttgcggaatatcgtcgaagtgcaactccagaaaacgattcctaaaagctcttgaaagaattttacggccaccgtatatcccaggtggattctgggtagcaaaaagaaggaaatcaggatgaggatgtacaacttcttgtgtttctggaataaaaagttctctgttatcgtcaagtaacctatttaaggcttctaaaacatcggttggggcaagatttaattcatccaaaacaatccaatatccttttcgtagtgcctcgactaaaacaccttccttaaacgacagctttccggtatcatcggtaacatatgtacctaaatattcctgtaaatctgtatgctcatggttatttatacggacaaacttatggcccgttatatccgcaagatatttgatcatactggtttttcccgatgaagttggaccttgaataagcacaggaaatcttttgcctgatgtagctcttaccaaattcatcatattcttttcaacaaaaggcgtaatgatatagtgagcttgttcttgaattgtattagggccctttttcatccaataatgcttaaactgaacataatctggtcctggagagggaggtgtctgtgacatgattgacttgacattttttagcctccccaatgtgaatttttctattactggcttcagaatggcctcagatttttggtccagtaaagtcaaaaaactcatacagaatccatcatacagggaacggcgtagaccgtagatatgaataatatcagtaacataaagcaatgtacgcgtcagggtacggatactaaagtgtggtttttggtttgagccatcaactatagtattgttatcggagagttttttggcttcaaggtaaagttcagcgatgtcatttcctacccattcatcgctgacgctgtactttccaatatatttatcaattatggaaagcaaatcagtaatatcacgttccggagaatgtacatatatttcggtaaatcttgatctgatacccataggtaagtctcttttaccaacatcagtagcggggttcatacaagcaaatattctaaaatcggggtgagcttttataggctcagcgtcacccttttctgaaagaagaatactacgagaatcaggctcggtgagaaggtcagaaatactttctaaggtatctgcggttgctaaattcacttcatcgagcaatagccactccccagccctgatagtctttaccaaagaaccctcgacaaaattgaagacaaacgagttttcaatagagctagactgggcctcaaacttcttcactgagtcattgaagtcagcccatttgtcaagtaacaattttttttcatgagtattgagtcttcttttcttcttctttgcattttcgttttcattttcagtgtttgtaatttttaatatgctttgagccattttgtacgcttcgttccaaagtttaacaacgttcttccattgattcttgttgaagcacctatgtagcatcttgtgaaacttctcgttcttctttaaggaaaatgtagcattaaaaagagtttcaaaattttcttgtataggaactgcaactgttttagaatttacgggtttgtacccaccaagaagatcaccagtttctgtttgttgtgaaacattgattaccgttaatttttttgctaacatcttagcaagttgttgaacgactgtagttttcccggtacccgtttcaccgactagtaaaacaggttcagtcatctgtatacaaacagaaatctgttccattagtcttaaagaatgattcgtaaatgcgaacaatgtgctgttcattgattttttttgtatatttagcttttccttaagtaatacggctcttccaattttaatgctatcatcaaggttttccaaagtgggcacatgttgggtcaaaaataacgaaatccttgaggaagcaatgtctaatgactcgccgattgcttgtataataggttccaaagctttgaattctccaatagcgccagcgaaacagtcggcggcttcggagaaaatactgtcgtagacagaagactggattagttggtcaggtttgttgatgccattgtttttgaataggatgtctaacctttcgcacagcttaattaaatctcttacagatacaactcttgtgtgtgcccccttgttcaatgaaatgaacttggtgttcatataaatacttttgacgtttttgtatgaatcgattagtttggggataaggttggtcaaaatgggaaacttttgggctaaaatgtgtgtcaaatcctcttcgctaggttcctctaattcaataacattccagattctcataccaatcatattcaagttatagatcttattggaactatccttctgatgatcttcgtttattctaacagttgatattaactggaaaccatttgcagcctttacagtctctcctctggatggaatggttagttcgcgcttttctaaaagcgataaaagtattgataaaacatctgtaggagctttatctatgtcttctataagtacccatctcccttctttgaccgcggtagcgagaacaccagctctccattcaaacgtgcctggcttgtcaccagaggtataagtaccaatcagtaacttggcatcagtttgttcacctaaatgaattttcacaatggagtcatggcaacccatatatttacttagctcattgattaaaaaggttttaccggatcccgcttttccaatgagcattattggagttgaattttgaatctttctcccgagttgacgaagagaggaaaccgttttatgagtagggacaaaggttaatgggtagaatactttgtcgtggatagtgtggaccttagggacgataacgccacagattgacgcgaccttagtactcaaatcctgaggctcaataatgaagtagctagattttttttctatagtgaaacattctggaacactgggtagtttagagaaatttgcacatctcttagcttcgttcagttcgaggaagctgtaatcaattccagaatcgccctcaaaatggcccaacaatgaatcgcgtgattttatataagtgtcgagcatatcgtttaatgttttttctcccatgtctaagtataaagataaaacctttaatgctagaaatataacaacctgattttcttgttctttggtgagtaaatccacaagttggtataaaatgtcgggttgaatgaagcgtgcaaatacttctttattgtgatatagtaacctatagtatgctaatagtattttaaacatgtcggaatccttttgtgtggatggattttgaagaatagtgatgaaatgatcattctctttatctaaatagtcttcaattaatggcattgcaacgggaaatattgtaattatacttgccaacttttcaattacaagaacgtaatctttttttttggagtcctttatccaacgtgccactatctctaaaaaaatatgtttgtaaaggaaaacatgaccagtgatggaacggctatgtagtatagttcctgctaaattgtctaaattctcagaagttgattccttgttgctaaagtggaagggcgcttcaatagcatcagagggaaaagcagaattgaagagaattaacctttggttaactacgtctaaatctaacaaaattctatcctgggacattctcagcagattataacggttttaaaaataatgtgaccgcgtaaagtagaggtaccttaaaataataagagtagaattcgatgtcaaattaactcagaggtactttgaatctttaaaataatcactttggagaggaatgtctaaagtaaagcagtaagtgatataatgttttcttttcataaagctaaatagaccttagctcatcgcttctttaaaatttttcactcgaaaaagaaaaaatacctcgtaaagggcgacaataaatgatgagtagaaaaagaaatggaataacggttcaagtgcatttaaaatcaatgccttgaatatgtgtttcagtatacattcagtttgactatatatcaagagaaagctttagtatgggaagtttgttgagaccggttgatctggtaaatcaaccgcttggattccaagaaagatataaaattttgcagaaattattcaagcagctacaaaaggcatatgcacacacaaaaggaactaatattgaccttgaaagacttgccactcgcttagaagtccatgttgctaaaaacagcttgtctggtcagagttacaagtttaacatgagcattttactgcgggatgtgcttaaatataaaggagatctctcgaagatcaaaattaatgggcgcccccttaaaggagctaagcctcatttatcctcaattggtaatgcaaactctatcactacaaaatcaaaagcgatggaagctttaaaggctctgattttggattcgaaggtcttagagaaaaatgggtatattgttaaggaaatgcaaaataaaactaatgatgacaatagtacgcaactgtatgcaccttgtttgcgttgcagctcaaatttcaaaaaaacagacatcatggaaaagactctatgtaggtatcaccctttgaaaagaatatacaacagagataccaagaaccatcagtatccatgctgtggtgaaactactgattccgtttcttttctaaggctaggatgcaagacgttttttcaccatgtgtttagaggagaatcatatgacgagttatgcaaaatttcgaagttttctagtacagatgacattgatggtgttgagaatgttctttctcttgactgtgaaatggcttttacatcattgggctatgagatgatacgtttaacaattgtggattttttcaccggcaagacactatttgatcatgtaattcagccaataggggatattgtcgatctgaattcagacttcagtggtgtccatgagattgaccgaaccaattgcccgacgtacaaggaggcacttgatgtttttttatccgaaaacttaataaataaaaatagtattcttatagggcacggactagagaacgatctgaacgtcatgaggctatttcataataaggttatagatactgcaatactttattcaagaacaaagtttaaggtttctttgaagaacttagcgtttgaagttttgagtagaaaaatccaaaatggcgagcatgatagttctcaagatgcaatagcaacgatggacgttgttaaagtcaaaataggtatttctccaagtcaaaacaagtgggaaaaataatgtgatcatattcaaagttgagcagacatatatagttattacatttcatacggttcacatgagttttattaagtaattacgttaagaaacaacatgataaaagtaatgatttcgtattgctttcctattttctgtatttaagcgaacaataataatgcaccttttcaatatctgaatattaaaatatcgtgaaattgggttcaggatgtaccaaacttgatgatagctgaagcaccataatcctatttaaagaagtacctgttatccgtcagtaattaccagaacaagttaattttaagtttaatctaaaaaagtattgcatgcggcattaaaagacaacataaaacatctaaacggtaaagtatgatcgataattctccataatagttctgttatttataatctccagcactaataaatgctatacgtatatttgtacacaatataatttcagaatttatattgctaccatgactgtctgagaattgggggaataacttgataattgttgggattccattgttcgtaaacgcaataatattaggtatatagaagatactaaatgttctctccgaggatataggaatgctcacaatggaatcgatatatttctacataatagtattgagattattcctcttttagttttatataattcattatcctattacattatcaatccttgcatttcagcttccattagacttaatgactgtttctcaatttttatgtcatcttcctggacctcatgtgatactataccagtagcatgaatactactgaatcgatgatactttagagtttcattgcaacagtttcaacacagcctggcatgaacagtggtaaaagtatttcgtccactattttcggctactataaataaatgtttttttcgcaactatgtgttcgcgaagtaacccttcgtggacatttggtcaatttgaaacaatacagagatgatcagcagttcccctgcataaggatgaaccgttttacaaagagatttatttcgttttttttttatcatcgagtgaagtatcgtgacttgtacatttgaagatacccagcgtacagcagtgtatctttatcttcctgtatgatatagataactaacatctcgaatagaaaattgtctcgcgttcgaacctaagcctttgctatcggttgaacatagaagaccgcgtgattcattttagtgcgtaagaatgctattagtacttatgtgctttatgaatgtgaatattgttacagctatgcaatggtacgatcatactctgaacgatccatttaaattatatatgtcaaacagaagagaaaggtttttttattgaagatttcacagaaaatcaatcattttgcaatattccttcgtcccagagaaggtttcggcttttacagcaacgagaatgattcttccattatttgtacctagcttccacatggatttcgataagtgtagtttcaaaccatgaacgcaattcaaaactttcaaattggtgcaatccaagaccctccctttacatttggagtcgttaactaatgagaaaatattacagcattttgcgccatttaccgtcaagtcacaaatggagacacatgcaggaataattaagtgggattcaacttgcatttgactgtcacgaagtttgaccttatattcggacagatcaattttaaaatctgggttttccaataaaacatccgagaacttgttttcaaacaacactgcagcctctctggataggtctacatgaacagtcttattctttttgttgaatattattttgcactggttagagtgtaattggaaaataagatcgtgcgaaactgtatcgatataaggcctttggtattttaacatgctccagtgtctttcaatacaatgttttaccttttttgttggaggttcatattcatcattgttgcctgaatcagtctcggttttatgaaatccagtagcggctttttcaccctcagttccattgagacaactgcttaccgctaaagattggtttccggtatgaagtgatgttaacctttcaatggttacacccttcttggagacgctatcaagagctatgcaaacttcttgacaattagttaagggattatatataatttttgcccgcactaattcctgctccaacctgttgagacggtaataacgacactcttttatcagagatgcggttctttcctcagacagttctaatttggaaccgcccagtaaagataatatatctcggaaaaattctggggaccttgcaatatatgagggtggtaataaaggtggaaagcccggcttcttatttgactcccacttctcaatttcctcataagatatgcgagaaatcgtttcaaaatagttcaaccggttcccttcttcatggaataatgattttggtaccttaaagggaacacctccaatattagtgaagtggtagtcgtattcttttatgagtttaactaacttgggtaactgaaaatataatgcgtccgcgaaaagacaggtaaattgtacttcgttcttaatatcgggaaaataaccttgtaaatgtctgtatattatgatgaacacgtcttccgatctatcaacaaatagaatcgtatttttatcgtgcgtattgaagaattgggtgaaaaaattgggcgcatccgaattcaatgtagcacctgagatctcaaatagcttttggccaatcctaatcttgaaaacttcatggtttggtaaaagctcgggggtagtttctaactcttttgtataaaccacgatctcgcccttttggccagacatctgatatgagcgtgcgtgtgagtgactttacacttgtctatccacgtcctgaagttgttcgtgttctttggatattcgtgttcaagctaataatgagcctttaaggtaatacaatttataaaccaccaccttggcctcgatctattgcgcttatgttgtctattagtaatcaagaaaagaaccctaaatcatcggcgtcccctgtggggctctcggaaaaaccggtcctgacgtcactgaaaagatttcggcacatggtcatgggaccagagaaaaattaatccgacatgtggaatatttccttccgttaaggtagtgagcgcggattttttctgatttgtaattatacggggagctctggccaaaaaggtcagtatttggtgatgaagttgaatatcatcttttgattttcttctgtatcattctttttctttttccacaccccttccggacggtattcacatattgttgagaggttaaatgaaaaataaaggggtggaaaattaaggacgagatgtaagggaaaagcataaacgaaacattatataaaggagcacaatttcctctcccttgccaattgtgcatataccgtttctttataacgaaatttcaacaaaccagaacaacacaagtactaccaataaccacaacaaaacatgtctgacttagttaacaagaaattcccagctggcgactacaaattccaatacattgctatcagccaaagtgatgctgacagtgaatcttgtaagatgccacaaacagttgaatggtccaaattaatttctgaaaacaagaaggttatcattaccggtgctccagctgctttctccccaacctgtactgtcagccatattccaggttacatcaactacttggatgaattagttaaggaaaaggaagttgaccaagtgatcgttgttactgttgacaacccgttcgctaaccaagcgtgggctaagagtttaggtgttaaggacaccacacacatcaagtttgcctccgacccaggctgtgctttcaccaaatccattggtttcgaattagccgtcggtgacggtgtttactggagtggtagatgggccatggttgttgaaaacggtatcgttacttacgctgccaaggaaaccaacccaggtaccgatgtgaccgtttcctcagtcgaaagtgtcttggctcatttgtagatgctatgtaatagacaataaaaccatgtttatataaaaaaaattcaaaatagaaaacgattctgtacaaggagtattttttttttgttctagtgtgtttatattatccttggctaagaggcactgcgtatacttcaaggtacccctgtgttttgaaaaaaaacaacagtaaaataggaactccgcgaggttcaggaacctgaaacaaaatcaataaaaacattatatgcgtttcgaacaaaattaaagaaaaagaataaatatagattaaaaaaaaaagaagaaattaaaagaatttctactaaatcccaattgttatatatttgttaaatgccaaaaaagtttataaaaaatttagaatgtataaataataataaactaagtttacaacaacaaagcagcggcaccagccaacaaagcaccagcagctggcaaagccttagcagcagcaccagtgtaagaggtgacagagtgagttggagcagcagaggtggtgttctttggagcttcagtagaggtaactggagcagcagtagaagtaccgttctttggggcttcagtggtcaatgggcaccaggtggtgtattgagtgataacgtcatcgacggtgacggtagcggtggaaaccaaagctggggagacagtttcagaacagacgtggtcttcacaagaagtgatggtgaccaaagtggtagattcttggctgacagtagcagtggtaacgttagcagcggcagaagcgacagcggcgacagcggcgatagaagcgacagtagaaaattgcattattgatatagtgtttaagcgaatgacagaagattaatttcttggtatgttaggaaagaataaaggagaataagaataattagaacaatgtaggatggaaagaaagattatcaagcatgccgactttatatacttgaacggaggcaaaggatgcaaaattttctcacatttctttctgccgttatgttggaagtaagactcccattatcgcaatactgcaacacgaatatgcaaaatttgctgagttatcgcagatagttgttgcaaagatagcggcgtaggtggccgcgaaatggggaattccaaaacaaacggtttttttactcctgagaaatacttgtacgggataatccagggcctaccacccacgcttcgaggattggcttttatttttttttttttggtggcgttttatttctttcccgctttctgggacttgtgcggagttttgagaggggcgcgcggcaaaggattcccaaaacggaaatcagacgccaatagccagcactcaaagcagttctggacccattccgattttcccatttggttcttgcgcgtgctgattccgacacgcgcgtctataaatagcatgaagtatccgcacaccgcagcgttagtgaggtgagggtggcagcaagctaattcccgcatctggaatctgaactgccccttttggactaaccgtgtggttcatgggtgggcgaagtgcgcaacctcgaaggttttcttttgcgtgtcggattttacatccggcggtagcgcatgatgccatggctggctccagatacatcctcagggcaccagcatctataattagattggcgcaacatggctggctgcactgctgtcttcacttctttctttttccggcaatgaatgatgtatgttttgtggcaaaagggtccgcattgtacctgtttacagttgagattatcgtttttggtagcccttcattacggcataacgtattaagtttcttttattttgctttgccctggtttaaaagacaatgtcgattaaaagttaattttaatcgattgaaggaaataagaggaatagcgcaagttgttaggaaagcgttctttatctccaagactttgccctgtatataattaaacacctcaaagcgcttcgtcatggatggagattattcggcattttgacatacaggagtgccacatgcgaaagcggagtgggcgtattctctggttaccctacatggtctggcggcgttattatacgggaggatcttcgaagggaaggaaggaaaaaaaaaaagaaaaggccaacgaaaagcaaatattatctatcgtcgaaattatcatactatcttacaataagagtagtaattactttcttgtttgtatagtggaagaggaatttgcgataataatagcaaaagtaactaatctctaacaagaaaccttatttattttctctttcttctatattggtaaatactagactcgaaaaaaaggaacaaagggaaaacagggaaaactacaactatcgtatataataatgaccactaacgaggaattcattaggacacagatattcggtacagttttcgagatcacaaatagatacaatgatttaaaccccgttgggatgggggcatttgggttggtttgctcagccacggacactttgacatctcagccagttgccattaagaaaatcatgaaacctttttccactgcagtgctggccaaaaggacatatcgtgaactaaaactactaaaacatctaagacacgagaacttgatttgccttcaggacatatttctttctccattggaagatatatattttgtcacggaattacaaggaacagatttacatagactcttgcaaacaagacccttggaaaagcaatttgttcagtatttcctataccaaattctaaggggtttaaaatacgttcactccgcgggcgtcattcatagagatttgaaaccgagcaacattctgattaatgaaaactgtgatttgaagatttgcgatttcggtctagcaagaattcaagaccctcaaatgacaggctatgtttccactagatactacagggcacctgaaatcatgctaacgtggcaaaaatatgacgtcgaggtcgacatttggtccgctggttgtatttttgccgaaatgattgaaggtaagcctttgttccctgggaaagatcatgttcaccaattttcgatcatcactgacttgttgggatctccgccaaaggatgtgataaatactatttgttccgaaaatactctaaaatttgttacttcgttaccacacagagatccaattccattttctgaaagatttaaaacagtcgaacctgatgccgtagaccttttggaaaaaatgctggtttttgatcctaagaagagaatcactgcggcggatgccttggctcatccttattcggctccttaccacgatccaacggatgaaccagtagccgatgccaagttcgattggcactttaatgacgctgatctgcctgtcgatacctggcgtgttatgatgtactcagaaatcctagacttccataagattggtggcagtgatggacagattgatatatctgccacgtttgatgaccaagttgctgcagccaccgctgccgcggcgcaggcacaggctcaggctcaggctcaagttcagttaaacatggctgcgcattcgcataatggcgctggcactactggaaatgatcactcagatatagctggtggaaacaaagtcagcgatcatgtagctgcaaatgacaccattacggactacggtaaccaggccatacagtacgctaatgagttccaacagtaaacgtgtttttttaatgtccctaaccactcattcttacttctttttgatgtttcttttttttatggtactcataaaagtatttacgtatatagttgtatagaggaaacaaaaaaaaaaagataaaactcaattacaaagtaaagtggacgtatttcgatcatgatttttttctgttttaaccgcattggattttcttgtaaaactggaagaaaaaggaaactaaaaagtcaagaaagacctttttaagactccaagaaccgtcacttatggcgtattgtttgtttatcagcacttctatcttcgataaaggtttgtctgtcttatattgtttacatttcaagtctaattctgtgcttttaccgaagaggaattttcataaatacggagaaaatataaaaaaaaagtaaatacagaaaatagaacagttgaagcagaaaaagagaacttgctaaatagctgtctcacccagacaagcgtatacttaccacatttagtcttttgcaatctcattcttgttgaagataactattacattcacggactgtggcagaaacttctccttaagaaattaggaactcataaaaggaatcagcagctctatgtaatatcaaaatcttttctattttttgtatttatgctctcattcattaattctaacggagctatttattataaacagtgaagatataaaccatatgtctaatagaacaaatttcaaaaagtcttcaatttcgtggatgtgggaatgcatttattaaaaataatgaatggcaacatacgacaccaaaataggaacactttcagtactatacagaactacggatcttagtttattgagttttgagaaataggttgatatggagacaatttcttagcgttattagaggttataagtatacagaataacctacgagtagtcctcaagaagataagactctgcaaaaggtatcaataattttacttaatcatagcactatttcttctttcgctttgtacagcagctcatatattccattacattatcaattcttacatcgtagcataaaacactaagattcaaaaatagaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacttccctaagactgtttatattaggattgtcaagacactccggtattactcgagcccgtaataaaacaaaaacaataaatcttgttcctcgtggcccaatggtcacggcgtctggctacgaaccagaagattccaggttcaagtcctggcggggaagatttttttgctccgacaattatgtcgctacccttcagttttgttgaaaatgatgcttttatcgttaactttacttatctttattgtttgcaagattactattaatattaaagagggtctagcaaggatactgcgattgtttctaaatatttcaactttctacgttattcatctttaggaagctaaaaagcattcaaaagattactatgaagttaatctttaaacatagtttgatgagcgtctatgcaaatagaataacttcaaaaaattttctattccatttttggaaagccccaaaaagctatattctataatttctgaatcttattgtgcttgtggaggtcaccccagttttctataaattattattcagctattatcccaatacgactaaaggtattgagattcacggatattttttcccctgcaactttcacaactggagggctctgtttcttgattttctttttgtcatataaacatatcttagcgcgattgctaacaaatagtatagatatcataatttttcctcatcctgcacacaattacctatagcagcgtcattcgcaccgccctcctcattggattttttaactgtatttctcgttttagatgagtcttcaacatttctatcgttttcataaatatcagttttactgtcggaatttttattgctctcaggaccaccttcaatatctttatctgcaacggtttcgtcctcattaaaattttctgcattaccctcaaaattctgttcattttctttatcatgatcagtgttaatgttcgtaacgtctgtaaaaccattgctaaaatcttgactgtcttccttatcgccattttcatcgccctcaccgtcatcgccattttcatcgccctcaccgtcatcgccattttcatcgccctcaccgtcatcgtcatcgtcatcgtcctcactatcatcgtcatcaccaccatcatcatcatcatcctcagagtcctcatcagtatcatcatcttcattgtcctcactatttcccacctcttcactttgttgatctgtctccgcatcaggtttataatgtaaacccaagcccatcatagctttctgtatcgcgttcgatgttttacttctgtttttgagatcttctgtggattcagtaacatcttcattagcagtattctttggtttattgaaatattccttccatgaattccataagttggctgctggcttgtctgtattctttccaggatttacagaaatttgggaaacagacttttttgactcgatgctttcctggtctttgatatcctcctcgctttgatgaccatttttattgcttgaagagttgctagagcttctttttaaattatgaaatgtggccaaaaatcgttgctgtaatagagacagagtgtcggcaccgttatatatatgcttcggaggaaacaagtcgaacaatctatcatctgttcttgagttgaatatcagaaaattttgagtctctttccaactctgaacccaattcaaattgaataaatgaacgggattggaatttagcatatcctcaggtatagtcttcaaagcttgatcattctctttatgcaggtccaaataatcacttaatttaacactggaaagtaaccccgttaaatagtcctcgaattgccacctaatgaaatcctcactgccttcaaattgagagttttttggagtttcatcatcattttcgttccatgtgtctgatacaattccagatatagattcaatccattttttatcatgacttgacaattggaggacggggttcaaagtcttgtccagaatatctacagtggaattgtctgtattgacaaatatgtggcacagttcctccttttgttcagcaagcaatgtgttggaacttccaatcataaaaaacaaagtacgttctgaccgtatgtcattcatttgctgcagtggagtatagggtgaaaatagtccacctttttcgaaaatcggtaatggaaaacctaagaatctcaacactgattctcgattgcttgatttaaacgagtccacaacatttaatttcgaaatatcctgaaacaactgaggactgccagaatcctgcaaatttgacatcaagtccggaattaagctgatcagaccgaactgtaaattacacaaagcttccacgtcgttgccgtaaactataatttttttttcaagcataattgctttcaataagactaaagcgtttctcttaaaatcatgtagtatctttctcagacataacccaatataaagacgattttcggcatttctgaccaatgatgcaggcgtgtaaatcgacttcaggttttcgtataaagactggattatcttcctgtccccaaaatcatgctgcaagaaaaaagcattagtcacaatactaagtttgtccttgatttgaccgaagattggttgccttgagatgactacaattgccttctgtacagtagatcgtgttacatccttatctttagtgaccaattcatcactctttatctgtctcgagcaagatatggcaaacaaagtcgtgttgtcattgatgctatcatcactcagatcagttgccccgttgggagggctcctttgtcttctttcatcatatagtaatgtgaaataagtaaatgtttcttcaaacgagtgagaaccatcaggaagggcctggaagggtaaatttggccatagttctgcactttgggtgccctcaggtaagccataccagtattctatttcagggcctcttttgtgatgaaagtccacaaggcagataccgaagatgactgcttcctcgtgttcatccattattttgacaacaaggttgcagcgaggcagaatgtatatgttagtttgatatggtcttcctgcttggattcctttaaggcttcaaaattttcttgaaaaggaaacttcgtgaatgagctgtaaggatgcttgatcgggccgtacattcttatgcaagatccattattgactgctctctgttgggttagcttccatatcttccgttacccgttcgtataatcattacccgacggacaagcatcatttcagcggctatttttgctaggcaaacctcctaagcaatgatacttctcaaacgttcaatggaagtaatagaagttcaacttaccccattaataatccacacattagaaggttgggacaataaaaataaaaagcattaattagtgtaaactttgctcccaaatgcaagtctaaggtaagttctttggttcatggagtttttgcagtgtaatctcacgtgcactagactgagtaaagcgaacctgagttcaagaaataatgattcacctatgacatatagtccaactatacaagcaatgaacccttacggattgaagtcattcaatgttcaatgtttgttgtaataagaaatattactagaaaaagattttttctttcggcggcgttttcccgcttttcttaaacaatctgcagttttaacatcgaattcacgaatatttgttcgctaaagaaataacacagaagatgaaatgaagaacatacattgagggcgacgaatatatatgacttataaatacaattgctgtgatgatggatcaggaaccaccgttggttcagtggtacgatttgataacgtcaccttgttaatcgatcccggttggaatccatctaaagtatcgtatgagcaatgcatcaagtactgggaaaaagtgataccggaaattgatgtaataatactatcacaaccaacaattgaatgtttaggtgctcattcccttctgtactataattttacctcgcatttcatatccagaattcaagtttacgcaactcttcctgttatcaacttagggagagtttccaccatagattcatatgcatctgcaggtgttataggtccatatgacacaaataaactcgatcttgaagatattgagatatcttttgatcatattgtacctttgaagtactcgcaattggtagatctacgatcaagatacgatggattgactttactggcgtacaatgctggtgtgtgtccaggtggttctatttggtgcattagcacatactcagagaaattggtttatgcaaagcgatggaaccacactagagataacatactaaatgctgcttctatattggacgccactggtaagcccttatcaactttgatgaggccctctgcaataattactactttggacaggtttggctcctctcaaccgtttaaaaaacgttcaaaaatctttaaagatacattaaagaaaggtttgagttcggatgggtccgttataataccggtagatatgagtggcaaatttctggacctgttcacacaagttcatgagttattatttgaaagcacaaagatcaatgcgcacacacaagtacctgtacttattctgtcttacgcgagaggaagaactctaacatatgccaaatcaatgctcgagtggctgtccccttcactacttaagacatgggaaaacagaaataatacttctccatttgaaattggatcacggatcaaaatcatcgcaccaaacgaattgagtaaatatcctggttcaaagatttgcttcgtatctgaggtaggagctttgattaatgaagtgataattaaagttggtaattctgagaagacaaccttgattttgaccaagccgagctttgaatgtgcgtcgtctttagacaagatactagaaattgttgaacaagatgaaagaaattggaaaacatttcctgaagatggtaaatcattcctctgcgataattacatttcaatagacaccataaaagaagaacccttgagtaaagaggaaacagaggcgtttaaagtacagcttaaagaaaagaaaagggacagaaataagaaaattctactggtgaaaagagagtctaagaaactggctaacggcaacgcaatcatagatgataccaacggagagagggcaatgagaaatcaagacattttagtggaaaacgtcaatggagtaccaccgattgatcatattatggggggtgacgaagatgatgatgaagaggaagaaaacgacaatttgttgaatttactcaaggataactctgagaaatcagcagcgaaaaaaaatacggaagttcctgtagacattataattcaaccaagtgccgcttcaaaacataaaatgttcccatttaaccccgctaaaatcaagaaagatgattatggtactgttgtagattttacgatgtttttacctgatgattctgacaatgttaatcaaaatagcaggaaaagacctctcaaagacggtgctaaaaccacgagccctgtaaacgaagaagataacaaaaatgaagaagaagatggttataatatgagtgatccaattagcaaaaggagcaaacaccgtgcttctcgttactcgggattttctggaaccggagaagcagaaaattttgataaccttgactatttaaagatagacaaaacgctctccaaaagaacaatctcaactgtaaatgtccaattgaaatgctccgtagtaatcctaaatttacagagtttagttgatcaaaggtctgcatctattatatggccatcgctaaaatctagaaaaatagttctttccgcccccaaacagattcaaaatgaagaaattacggcaaaacttatcaagaaaaatattgaagtggtcaacatgccattaaataagatagtggaattcagtacaacaataaagaccctggatatctccattgactccaacctcgataaccttttgaaatggcaacgtatcagtgatagttatacagttgccactgtcgttggcaggctggttaaggagagcctaccgcaagtgaacaatcatcaaaaaacagcgtcaaggagtaaactagtcttgaaaccattacacggttcatctaggagccataaaacaggtgcgttgtcaatcggtgacgttaggttagcacaattaaagaaacttctcacagagaaaaactacattgcagaatttaaaggggaaggtacacttgtcataaatgaaaaagtagcagtccgcaaaatcaatgatgcagaaactattatcgatggtacgccttccgaactttttgatactgtcaaaaaattggttacggatatgttagcaaaaatctagccttcttgtatacagcacaaataaaaggttcaatttacgttcgtggactgcccacaaaacagtatgtgacataaattgctgtgtatctcgcaccgctattatctgtatataacattctaactcacttttaacgatattagcattattgatttctttctttttctgctgaatttcaccaagcggaaattttcaaagcagaattttttccctaatttgctacaagtgctattctatcccacaataaaaggaaattgttgatgagttttagaaggattaactctagatactttgaaaatagaaaaggaagcagtatggaagaaaaaaaagcaaaggttcctccaaacgtcaacctttcgttatggagaaagaacacggtagaaagcgatgtccatcgattcaattctcttccatcaaaaattagtggggccctaactagggaacaaatatactcctatcaagtcatgtttaggattcaagaaattaccatcaaactgcgtacgaacgattttgtgcccccctccaggaaaaataggtcaccttctccgccaccagtttatgatgcccaaggtaaaagaacgaatacccgtgagcagaggtatagaaagaaactagaggatgaacgtattaaacttgttgagatagccctaaagaccatcccttacttcgttcctccggatgattacaagagacctaccaaatttcaggacaagtattatatcccggtggatcagtatcctgatgtcaattttgttggtttattattaggtcctcgtggacgtacgttaagaaagctgcaagaagattcgaattgtaagattgcaattagaggaagaggttcagtcaaagaaggtaagaatgcaagtgacttacctccaggcgccatgaactttgaggaccccttgcactgtttaattatcgcagactcggaagacaagatccaaaaaggtataaaagtttgtcaaaacattgttatcaaagcggtgacatctccggaaggccagaatgacttgaaacgaggacaactgagagaattggcggaacttaatggtactttaagagaagataacaggccctgtccaatctgtggtttaaaagatcataaaaggtacgattgtccaaacagaaaaatcccaaatatacagggcattgtttgcaaaatatgtggacaaactggacatttcagtagagactgtaactcatcgtctcaaagaatgagccgttttgacagaaacgccacggtaaataattctgcgccaatacagagcaatgacgtacactataatagcaatactcatccaattcaagcaccaaaaagatctcgttatgacaataactcgacggaacctcctttaaaatttccggcttcttcacgttatgcaccatcaccttcacctcctgcgtcacatatttcgaggcaagctcaaaacgtgacgcctacaccccctcccggcctaacatcaagtagctttagttccggagttccaggaatcgcccctcccccattacaaagccctccagagtcggaacaaccgaaattttcgctacctccacctcccggtatgactacggtacaatcctcaattgcacctcctcctggcctaagcggtcctccagggttttctaataacatgggcaatgacattaacaaacctacacctccgggactgcaagggcctcccggattataatacactcccattatacaatatctgcatttttttttatttgtgttgaaggtatgtagtctctattttgcatagttcctttttttgttggttttttgccttcctggttattattaacttttgatatttaatttacttactagcttattctactactgtttagtttctacggcctgaactacaatgacaaaaatattatttcacgatacccttacctttattcaaagtgcctgttcctgtttccattttttggctagttccaagaactttgatggttttggcttgtcatcatcgatatcatcaggaaaaatgtaatccacgaattcttcttccacaccgttctgtaacctcacttttttgattactttagggaatcttttcttgacggtttcttgatcgagttcagtaccgtaagtttcttcatagtcttttagcgcttccaaaatagacagtctcccttgtttatcatccttctccttgaaaaaaactatcgcctcttcaaaaacttttcttgcctccaatttattctcatcggtaatttcaaactctatgtcttcatccacattttcgctttgcagttttgctaaatctaatagttgttgctccgtcggggttgaagtttgatacatggcgaattcgatccagctttggggggaatattggttgagctccaaatatcttctataaagcttccttgccttttcaaattcttgtgattctgtctcaaatgttatgtatttttgaagtaatacaattttagcctcctttgttaagaaatcagaattttcatctagtgcaattgtatatatacctcttactctatcccaatctcctaaattttcttctagttctccatattgtgaccaaatttgtagatcagagggctgaaattcaataaatttctcatatatttttctcacacgatcaaattccttcaacttcacttccaactcgatatatcctttgaaagttttagccttaggacataaaccgattgctttacccaaaatttttctcgccttcggtacatcatcatgtcgtatcagaaatttagcatacattagccatattttggaaaaagtgaaatgtttatgagggatgatgtcgtcaattaacctctgaaaaagttcttcttctaaaagcgaattttccaattctaactcaacatagcatatatatctcatccacagataaatataccttttccactgaacattttttgatagttcttttggtcggctgtccacaatagctttctcgaaagtttgcattatttgtttggggaaactttctgaaatgagatccaagtacagccaccaggtgtcataatcataggcgttattactcaatattgtttcatactccattttccttttatagctaatagtttcttctattgagtttatgtcaccaaactgcttttcaaaatccaacagtcctgccttgagcaattgattggagggccatttttctatagcaatttgataaagagcactagatctttcgtattcttgctgcgcagcttcccaatgagcaaatgaatttactaattttgcaacctccatatcagaccaaatctgtaaattttggaggttagctactgtgtctatcgctaaagaatacacacttctcgtaaattcagtattaccatgtctattttcaaacctcacccactttagccatgtctgcatttgcgggtgagccatgacgtattttgagtaaatctctcttacaccgttccagtttttctgtcttatttcaaaatccacgaaagaattccatgcattaacccctggctccaaggagcaccatttggtgtacagtgatcgtacaatttcaacgttgtttaacgactcttcgacaatgagatacttgtaccataacttgtctactctgggcaacgtactaatagctctgttcataagattcctagcatggttaatacatttgactttcagctcagcatcaatgtatcgtatccaaagggggatgaatgaactatctactaataatgctctttcaaagatagatctggcgcgcctcatgtcgtgttgttcgatttcgaattgcgcataacgaatccattgtcccatatccagtcggtttctcttcaaataaccctcatattctgttctcttccttcgttgatactctcgaagttcctccaagtctaatatatcaatattagtcgatcctcttgctttttgccccttcttgtacacatcccgcagaatctgctccgcagaaacatgcgtatcaacggctgttggctctaaagtgtccatgctggcaatagtagagtacttttagctcaagtttgtctatctattatgaacttgcataatcaatgagtctcatcaccccaactatttggcaccaaggtttttaattttctatcgcgtcttacggatgtatataaattatttaaccaagtataatagcggttaaattgaactcgcaatattaggaaaagagctatgatgataagctcttcttgataaatgaagccaagtcttctaattcatctggaactgtagaatgggccatacctttgtatactttaaattcataattttgtatctcacagctatcttgatagaactgttttgcctttatacctagtccaataggaactactggatccatgtcaccatgcccatgaaaaattggtgtctttacattaatgccattcttatgttgtttcagaattcctgggatggaacaaaatcccgacagagctactataccaccgattttccatggtaaagtaactgatgttgcgagagctaatgcggcaccctgagagaaacctccgataataatctgctccggtttaattcctttatcaatttcttgcttaaccgtcttttctatggaattcaaagaattcataaaaccgtcactgtcaactttggaaaaactaggatcccattccaagatgtcaaaccaagcaggcatcaatgcaccgccgtttgctgtcacatgaagctctggagcattaggaaaaacaaaattagtatgctggaaagcggcagggtctctctgttgtaaatactgagctaaaaatccccatcccgaacctgtatcacctaatccatgcaagaatatgatagtttggcgtgctggctgaatttttgctgcaactctaagtccattcatattcgatagcgctcaaatgggcaaatatagtgtatgtgttcttattttcgttctcttttgctaacatttttatttcatacagaagccatttttccctagaataggcgttctgaaaagaaggaaatatgaaagtaaaggctacaaaactaaggataaaacaacgaaggaaaaataaggggctcaatataagcagattagatattatcagagcagaaatggatgtggtaccatctccgggtttaccagaaaaagtaaacgaaaaaagcaaaaatattcccttacctgaaggaattaaccttttatcatcaaaggagataatcgatctaattcaaacccacagacaccaattagagttatacgtcacaaaattcaatcccttaacggactttgctggaaagattcatgcattcagagatcaatttaaacaattggaagaaaattttgaagatttacatgagcaaaaagataaggtccaagccttattagaaaactgtaggattttagaatccaaatatgtagctagctggcaagattaccattccgaattttcaaaaaaatatggtgacatagcattaaaaaagaaattagaacaaaacacaaagaaacttgatgaggagagttcacagctagaaactaccacaaggtccattgactcagccgatgacctggatcagttcatcaaaaattatctggacatacgaacacaatatcacttgaggagagagaaactggcgacctgggataaacaaggtaatttgaaatactagttcagcagctaccgccattatcaatatgtacgtatatagactatactttatagattattctagatgccaaacgaattattagaatattaaagcctttgattataggccatatcccaggtaaatagtatactaggaatgagaaaaaaaaatgtgaataaatggtaacctattcttagtgggtaagataaactattgtgaagtaaaaatgaagaccgccaacgtaacaataaaaaattaataataaaaaaaaactttgcccaagcgagagcaacgatttccgccagaaactccaactggcttggagatgtgaatgtctaaactttgtgcaacggttttcagatgaatgcaaaaagaagagaaattaatgtgaggggtaaagatggaactatatgatcaccaacatttcttttacttgatgtagaagtggcggatgcagtactggtcgtcaggttaccgctaaaggaagcagtttgtgaggaatttacagtaaatatgttaccaccggtaacaatagatgcacttgtggaccaagtgtttgtatagcctggtgcctttacggcgcttggaacagaggatgtaataatttcgatattttcgcttgtggtattatagcgagcttgtgccatggatatttcaagattctccaaatcataaaccacgtacgcgttagtcaaaaatgaatcacccaaaatggtacctgtgtcatcactcgttgggataatacctaaaagacatgtagtgccagtactcaagataaaactcgaaagtggtgcattgatgtgaaaaccaccaaaatcgaacactatttccatactatcatcagatggacagtccaatacgtaataccctatcctggaagagtattgcgcacctagttcagtagcgatcatacttaccactgtttgaggtaaataagtcaaagtagtaccggaatccaacaaagcaggtattttagtggtagtcaaggtcttgttactactcccagaatcactaataccgataccattaatagtgacatcaaattgaatgggagagctaaatccactagcactcagagtgtttacgatggggattgtgtataaggtgccggtatatttactgtggtccacggctccgaacaaaatggtgccatgcatagcgtccgagtcgttcaaatacaaagaatatgtgttgcttttgatagcaccagaatttttcaatacaatggggaagttgtcgtatttataagcttttccactatgagacgcagtagagccagaataagtgacttctaattcgggcaaaccaatacctaacacacccatagtagaattcgtttcattggcaacggcaaaagacaacccggtaacgttcaagtcgcttaaatccaaaacatccgtaccaaaagtaccggaggcaaaagtcccatcaccgtagctaatactgaaataggtgttgtttgatctaaatgtagaagagcccgaagtggaaaatgtcccgtattgttgacagtccatggtggcttccgaagcaggcacggattgagttgccgtacctgaaccgcctcctaagcccgtagcagtggggccaatggcactgcccgttcccgtcaaccagccaaatgggtttatatcattaatcaaagatccgccgcttgacgaatcatcacgtttgtcaataacacgtctccggctactacccatactgttcgaagaacagtatggattatccgagcccataatccatagatcagaggagcctgtgtccaccaggaccgttacgttctgtggtggcgtgcccacttccaagtccaccgaatagaaactttgctggttggtaattataatttcttcataaccgtcagccctcttcaataggcgtacttccggttttttgtcgcttcccacattttctagcgagtccccgtaaagcttatgaaagggcaacttgacgaacttggaattcgagtcgtcgtcgcgcttgtttgctgctggtattatcttaccgagaacctgcgatgcaaagagtgacgaaaggaccgcagatcttacagttttcagtttcatatgtggtaggtaatattatactatatgcttggtgttcaccttatctttttattacgctatgtattttaatatacagaaaagccaattgcgttcttcttaataaccgtccaattgcggaaataggaacaaatgcaaaaagaaggaaaaaagtaaatcctctttgacacccttttcttaagtagtcggatttccctgtttctccataaataagtccacgaatttttttatgaaacctcaattttttcggacacatcagtgaaacgaaaactactcatggcgcagtataaaaggagcgaaaagccactcagttgagtggacgagggaggtgaggtggtgacagaaaagaggaggaaggaggcagtgctatgtgagggtgtcttggctgcatgcaaggtctgacgatctaattgacgcgtcagaacgtgtgttttaggaatattcttatttaagtatgcttttcctcttgaaatcgcgcaaagaaggaaaggaaaaagtgtctatatatagtgtctattgtttttttttacgaaaagaaaacggaaaggatgagtaaggaggggactagcagtaaacccaaggtagagcgtatactggaagcggagttggtagcagccctctggagtgccctcttgcttttatgagtcgactttgcagtagtggtagagtttgtcttcttggtggtggttgacctcgtagtggtggcagtactggtgccattgaaagtgcgcacggtggtaaaaatattaccaccggacgtggcggaggcgtagttagaccaagtgttgttgtaactgggggcccttattgcactgggaacggtagatttgatgacttcgacgttctctttccccgtgccatacttggcttgagctagggaaatctcgtagttatccaaatcgtagaccacgtaggcgtttctcaagaaggaatcaccaaggatagcggtggcgttgcccgcttgtggaattattgccaagacacaggtccccacactggtctgcatagtaaagtcggatagaggagcgttgatacggaagccaccgaagtcgaaggccacgctggttttgttgtcgctcgagggacacgtgtactcataataacccaatgtcttggaatacgaggcattcaagctctttgctagcaaagccactgcctgggagggcagatatgttagcgttgtgcctgaatcgagtagggctgggagcttggtggtggtcaatgtgatgttgcgcttgtcggtttgcagtcctaagccctgtaaagtgacatcgaacgccaccgggtgctgataaccctgcgacttataaagattaaccaacgggatagtgtacagttggccctcgtacttgctgtgatctacagcgccgaagaggatgctgccggaggactgtgactcgtcatttaggaaaagagagtatgcggttgcatcgatggctccagaatgttttaggaacaggggaaagttatcatactcgtagcttctcttgtccataatagcgacttttccagaataggtgacttcaagcgtggaaaggccgatcccgagcacaccaaaggttgagttagattcgttggccacggcaaacgatagaccactgaggtctaattcgttgtactttaatttatcttgaccaaatgcaccttctgcataggttccgtcaccgtaagcggcataaaaaggcgaggacttgttggctttgaacgtggacgacttggtcttgtcgaacacgccatactggtcacagtccatcacagaaccgcagtaggggtttcccttgccaggaacccataagtcagctgagcctgtgtctaacagcacagtgaggttttgtgaaggtgtaccaatggctagctcaacagaataaaagctttgctcgttagctagtacaaatttttcatggccgttcgatctcttgctgagttcaccattgtcgccgttctttttttttgtgaagggaatcttgacgtatttcccatcgggaagtactctaccgaatgccggactagttaagactgctaatgtagccactgccgccaattgaagtttcatttttcaatgccgagtaattttgctctatttatcctatataaattcacaaacacacaagttagcggctacagatattcatatataatatatatacgtacatatatatattattatggcgtccagccttcgaccacacaagtttccttttgaggcttatagttctaagttcttcgctatttttaatttcttttccgcgaatagtaatccgatcgccaataatttctactacaaaggaagcgcgaaaaaaataagagatattttcgctatttcttttgcctgtacatggcccggccccaaatatccgattctcgtttctgtgccggattccactaccacgagactcagagccctataagccaggaggccaaaaagcaatctccattaccaacaatatcgcggtagtgaagatttgtatgtatattgaatgccaagacaaaatggtggccaattctgccattccgtcataagggatattgaattttgcttatttcatcaccccacgccattgttttgtcccgcccggaaaaactctgccaaaaaaagagtacatttctggcccatctccgcactaattcccctttcctttaaaatacgctgcttataggcgtcgaatggagaaaaggtagtgagtgattcctcaccctccactcagacgtttctgatatacaattggggaaaggggttcacacacagcaagccggtatgttacaattgtatttagataagtttttcgtttgaatgcgttgaaaattacttgcgctagcttcagctgatgtgccatgtaacgccgttctatccacgctaacttcaatagacttcaatagaaagcaaatagttatataatttttcatggacggtccagagaatgccacaaaagtgcggccatagaatgaagactgtatgaaagagcgccattgtccccacgtgtaactggggcgaagggcaggaattctgagagcaaactttgcttccagcattatgtaaaaaatcgaagcgcacaatcggacgcaaacatctgtgtagacgtagagaaacatgcagttttgatatagacgattcatgttgatgacgagcaaggcaatttcgagatttgactactgaagaatttctgtttaggagccgcttttgcattatcattgccctattacgagcccagttaatgttggttcgcctagtcttgggattgggatatagggttaggacgagtcgatcttagtggtacaaaggaacctctcatcatcctgagtccattgtctgcgttttttcttgaagctgaatataatgttgtaatttgctcgttctagcaacttcagcgaagccagtcttctaatgactccgctgttcccagaaagtgtgagcacttacatatatgaatacagcactatctggagaagtggcgcgctcttaattaaaatgatgcagcgtgttatcacatcttgcgttaccgggccttgcaaaaattgctatgtttttcttgtgcttggtattgcttcgtggagatatatattctcatatcaggacggaattttacaaagtgagaactctaaatggtgtagtaaagagaagaaaaaaaaatgctcagcgatttaccctcattacaaccaccgagattcactaggaaacggagctgtccctcggaatttattgtcaacatatcatccaatgttaatgtagaatgagttaccgtctgttacttttgggacggtttttgcactaagaacagacgagtttacggttatcctcaacaagcaagcaagtatttgctaatctagatgccattccgaatcattactcatacgttactattgagagatgttttacaatagatgagaagaatacaatgtccagagctcctggtatgctagagtgcatattccaggtcttattcgaatcatatcataccgtccatttcaacaatggtgaaatgtggtccacatatatcagaaatcttaacatttagtgaggagagccagtagaaaaatgtgcgcaagcggaaagaagtcattcacagacacgtttaacaaaacaccaccacagcagctttgtctcttgattctgatcagtttgccatcgaagaagcaaaattgtggtgttatttttttcaaacaaaacttttttggcaacagcagttttcttctggatatttgtactttatcatccaaccgatgaaagctggtttcctgtcaacctacatttaaatggcccgtacttcttcaaaaccgctagataagcaaattaacccaacttttgagcgtcctaaattccccttggctcagaagactcgttaatatgggaagtttaagtcctaccatataatcaaattggaagctttctgtgttcgaatggctattctaaccgctgggctattaatcagaggggaagtgaaatgaccgagacgtattatacgtcatgttgacatcaacaatttaaggaaaaaaataaaaaaaagcaatgaaaaagggtttttttaagttgaagacccttttcaaatatatgttgctttgaattgtatctaccgtctcgtttcttctgctttaccgtttttttttgccttctttagatatgtcttttatgcttgaaaggtccggctttaatgcattcatctaaacgtagtattcctatttttgaactgctaccaatccaccatgactttactatgaaggacattattagtgaacagcttcaaaaaaataaacttttcaagtcattaagatatatcttgttgcagcgtaagatgttggtgttcagtgcattctgtacaaaaatccgtgtaataccaagtcatcctcagtttacaaagcttgctagtttcctgcagtttggaatgaaccattaaagacgctaatcttcggatagagatcagctccttgatactgtataatccctatccacttgaattcctgttgcatcccagttctataggcatcacctactgcatcacctacttgtataatcctcgagcaggtatgctagctctgcgtcagtccttgcgatacacaactaatggaatatcttatgggtcaatcaaaaccattcttctagaacgccgagtttccagttttgggatttaagtaatacattaggtgcctgtcacgcaatccgtccgctgtatttctccgcatagaggatttcagtacgagagagtgaagagtcaaactaacgcaacgtagtagtggctttggacattgaaaagaatagtctagtctgccaagcatgggagaaattttagaactaactaataagaatttcatgagccacttgaaaaaggacataacttcgcaagaatccttgaaaagtagaattgaggataaaaatggtgatgtcgctagcccgaaagaggataactatcctctattgaatgaaacagcggcatggccagatggggtgattacctctgaagaaggatgttcatcttcaggtgagaaagagaattcaggcttatgttcagaagaaagttcagaagaagatccagaagaagctgaagaggaatctgcaagggcttttggagagttagttgcagtcttgcgggacaaagacataccactgaatgtattggacgaacctcagatgaaagattggcttgaaaaatacaccggtgtttatagaagctcttggcatggttgattatgaagaaaattccataattttgcgaggtgggagaatactcttgggaaagtgttgagaacaaaaacgccactaaaaacagcaggattattaaaaagtaaaaaaaaaaattaccttttcaagcaggcaaacaatgggttatttgaatggagaagtatgctactatttctgcatgttgtggatctaaggcgatgtgggcctagattctttcctttttttgtttttaccttaattatcttacgttgttctttccgtcagttttacacctgacatgggacaagagaacaaattgtgaaataagttcaagcctctgttgacatttattgatgtatctatttctttgagggttaattaaagataacaaattgctttcttccgctaatttgagcctattgaatttactgggaaatgccaacgtggtcagacatcaattcaagaagtttagttctcagagagtgtaacttgcctgtttggtcgctgcagtgaaactgccattagctctttagaacaacgttctaactatacgaggaccatattacgtaaatcaacaaacctcaagaattagtgtcatattttctcgcagatattactactgacattcagtcagctatatccattatgcatgagcgaaaaaaaagtgcatacaaaaaagcttatttattggacttaataaacgaaactatgtagtgccgaaccttcggatactgatcattggagtgatttgataaagtttctgcagaattctgggaaatgaaggaaatgacgtagcgaggccttcatgcaacactagttgaaattagaaaaaaaaaaaaccttataagctatctttcctatacgtcctctatcgactatataacccaagcagctgtttcatattttttgcaagaataacctccaaatattcctggcagcttgtatgccattgttatccagctcctggcactgtctttcgtatctattaaactcttcaagggtaagcttgtcttgagacttcaaaagccccttctgagcgacatcactattgaattcagggtgtccttgaaacgtcagcactctgttttgcctgtaaaatccttggttttgacatttttcacttgacgcccaattttggtatccctctgggacatcgaacacgcagtcactgtgcacttcagaaagatttaattcttgagcaccaaataacttttgacccacagagttcagttttagtgacacaaccccaccttcaaaccctttcggattccgtccaactgaacttcctagagcagccgcgataacttgatgaccaaaacatattccagctacgggcggatattcagtcttgctagttagcatctcatttaagaaacttcttaatttcataatccattcaatttcattatcaaatgaatcatattttgaaccagtgatgtatatgcctaaatactcatctttctgaagatctgacaattgagggaacacgtttttttgtacgtggaacacttcatattcgacatcttctgcgatacattccaatttcctggtctgttctaatagcttgatagccatatcaacaaaattgccccatggtttactccattcgttatcttcatctgtataaagaatagctattttttttactgtcattatgatgttttcttagtatttttttgatataattcaattctaatatatgttaatgcataattttcagagctatagcggtatatatttcaaactttctcaattatctatgtgaaattataaaccttatctgtcttttcttctgtacacctcatctgccacttcccactttggcgcgcgttgacattttgcgacaaaaagagattgttcgtggcagtcgtgtaaaaaactgcacctcaatcatgagtttttatgcccatttttcactatttcatatgaaccattggcaatgtacttcagcctaccctcatcggccagagtgtttaaatatccctctaattgttgaagagtaattcggttatatccccaatcttttggcacggtaattttcaaaaaagaatggatcttatgaagtttcattgcgcctaaattagtcagcattccttcgatgaatggcagacttctttgaagtgtcaattcatattttctttctatctcagaatcgttatgtagttcatagttactgttctcaatctccattggggcggtcttttgtgcttgatcaaaatccatctcgctatgttcaataacggaataggttccattttcttttaaaagcacacctttttgaatccagaaatctaacaaatgagttagcctgggaggagcaatatttagtgactcagaaagctgctctagtgataaacaaattggctcatcatttggagaatcaaactgatttattacgctgcattgttctaaagaaacgtctaacactaatttcctaccatctttgaaagctaattgtatttctacttttcctttatctttgcatagttgtaacttgcgcccaggtttcagctgtgagtatatatcagaatacttctgtagctccctttctaaatctattggtaaatgaaatgcaagatcattagaaccttgtgtatcgcagttgtacttccagtagaggagtgagataaattttggaaatattatgggatccagtccggctacttcatgcattttacggcagagctcctcgctacattttatatcccaaagcataacatcaatgctattcaaattcgactggtctgcatctgctgcaggggctgttgtttctaggagtcctaatataccgtttgttatataattggaatgacttgtttctgtgaatttgactattttttctcttattaatttcaaacatcgggtccatttttcatccaacgtataaaatttcaaagtgaataatctgtcggttaagagatttcgaaattctgatatgaaaaattctcttgattcaaatagatccaaaagcacctcaaacaaatttgtcttaatataacttgatttgatgttaccgggaatcatgtcattaggctctggtacccaagctatataataattgagtatatgttcgtatagcatggcgtgtcttattggtaggtccttgttcaattccctctttcctttcaccttgaggttccatagaaaggggctttttttattcttgtcccttttggtgatgttcgtatcttgattgatatcagaatcgtgcaaagtgtctacaagtgagagcagtgccttcatatctacattgaaattaattttctcctttagttcttcttcaggtaagtccaacattgcgtataacaatacatttactaagtgcttccgctcctgaaagtaaggtttaacaaacgtggttattgaatgtaggcatctccctgttggatccaggaccaaaaatgctttgatagttttaacatatctcaacaaagcgtccaccgtagttacgctggggtttagaatgtatttcttgaaatcagacaaaaaagttgttacaatatttgtgtagtctttaaaatctttcataattttcctcaattccaataaagtaacctttgaatcaggataagccaaaacgcatatatcaaagatttcattcgttcttatcctaagaaaattggactcaaaacagttgaaaactgtagtggtcagttcgtgatcatcctctggacaaccgactaatttagagaactgagaccaatattgattaataaatttgttgaatgtttccataatcataaaccttttattccatactctactcatgttatcttcacaaaatttattgattttgctgtaaagagcattgactatcaattccgtagaggataaggaaccattagcagatttgagccattggattaaattgtctgccaggtcgaaatcatcatccattattaatttgtctaatcttgttcttaaattatttttgaactttatatttctattcaacagataatgtcttaaagaattaagttcaagtgcccagtcgtttacatttacgtcaaaaataggaacgtaacgtaaaggaaactcgtaataattttcccatcgttggatatcttttagataattaatgttgttaaaatgtaagaaaaaatgataacgaacctggaaaatataaaactctttgagcgtggaaaaaagttgtagttgtaactctttgtttgtatttccctcattaactattgaattgtttgcctgactagtgtttatcatgctatatggcgatgtggttgcgttattagggaagagaaccttaatgatattcttaatacgaaggcttggaggacgtagttgatggttactcttggcatcattagggctcatccatgtaagtaaagagttcaaatcatcgactatgtttgtgtgaaagatgtatgaggaaagtgtttgtaactcatctgtaataactttcaaatctcgagttggggtaatctgaaatgacatgatggaaaaaccttaactataagccataaatatttacagtcccgctaagtctggctttcgtctagttttcgatattttggctcttttgtctattactgtttttgtaaccaaaggtttgaaaatttagatgcaactaatgaacttacgcagtaacatgcaagtacccaataaaaaaagaaatttttgaagagacgttcttgcattcaggacatggtatgtttttaatttcgtttctttagttctcaggctcttcaaagtactaacactttattggcaaggggcgctcaaatgtgatgcatcattatagagtaataataaaataaaaagaaaggatgcaagcccggaacaagaggcaattgaatcattcacctcattaaccaaatgtgaccccaaggtatccaggaagtacctgcagcgtaatcactggaacatcaattacgctctcaatgattattatgacaaggaaatagggacgtttactgacgaggtttcaactgtggctcatccacccgtatacccgaaggagctaacacaggtatttgaacactatatcaataacaacttgtttgatatagactcactggtcaagttcattgaggagctaggctacaatcttgaagatttagcgacattatgcttagcccatttactggggtacaagaaactagaagaacccttaaaacgagaggacttcctgtcaacatggtttatgcaaggctgttccaccatttcagacatgcaagagtgcatcaagacgttagatgttaaattacatgaagacttacaatatttcacacagatttataactatgctttcaatttgattctggacccaaatcgaaaggatatagatacagacgaaggcatccagtattggaagctatttttccaaccagagtacccagtgcgtatggaaccagatttgcttgaggcatggttccgtttccttcgcgatgaggggaaaaccactataagtaaagacacctggcgtatgctgctcctctttttcaaacgataccccactattcagaaaataataagcgattacgacgaaactgcagcctggccatttattatcgatgagttctatgagtgcttacaggatcagcaataaacatcctttcatatacttaagggtatgctgtttaatattgcatggaatacgttacccttctaagatagatgggaataaggcggaaataaaaaacgcgatgagcagtggaaaatttttcagaaattttcagttccctcataatatagatgtagatattgtataaggtcgtacgtatatcagagtagccactagaaggaccagagaaactggaataagagctattatggtcaaatcataccaacgttttgagcaagcagctgcttttggtgtaatagcctccaatgccaattgtgtttggatacctgcgtcatccggaaatagtaatggtagtggaccaggacaattgattacgagtgctctcgaggacgttaatatatgggatattaagaccggggatttggtcagtaaattatccgatggcttacctccaggcgcatctgatgctagaggcgccaagccagccgagtgtacatatttggaggctcataaagatacggatttattagctgtcggttacgcagatggtgtcattaaagtttgggatttgatgtctaagactgtgcttttgaattttaacggtcacaaagcagctataacattattacaatttgatgggactggcacaagattaatttctggttccaaggactccaatatcattgtatgggatcttgttggagaagttggtctttataaacttagatcacacaaggattccattactggcttttggtgtcaaggagaagattggctgatcagcacctccaaagatggaatgatcaagctatgggacctaaaaacacatcaatgtatagagacacatattgcgcatactggagagtgttggggccttgcagtgaaggatgatttactgatcacaactggtactgatagtcaagtaaaaatttggaaactggatatagaaaatgacaaaatgggggggaaactaacagagatgggtattttcgaaaagcaaagtaagcaacgtgggttaaagattgagttcataacaaattcgtctgacaaaacctcttttttttacatccaaaatgctgataaaaccatcgagactttcagaattagaaaagaagaagaaatagcaagaggtttaaagaaaagagagaagaggctaaaagaaaaggggttgacagaagaagaaattgcaaaatctattaaagaatcctactcctcctttatattgcatccttttcaaaccataagatcattgtataaaataaaatctgcatcatggacaacggtctcaagttccaaacttgagttggtattaactacatcgagtaataccatagagtattattccattccatatgaaaaaagagacccaacaagccctgctcctctcaagacacatactattgaattgcaagggcaaagaacggatgtgcgtagtattgacatcagtgatgataacaaattacttgccacagcatccaatggttcattgaaaatatggaatatcaaaacacataaatgtatcagaactttcgaatgtgggtatgcattaacttgtaagtttttgccaggtgggctactagtcatactgggtacaagaaacggggagttacagctctttgatctagcatcatcaagtcttttggataccattgaagatgcacatgatgcggcaatttggtcgctagatctgacctcagatggtaaacgattagtgaccggatctgccgataaaactgtcaagttttgggatttcaaagttgaaaatagcctagtgccaggtaccaagaacaaattcctgcctgttttaaaactgcaccatgatacaactttggaattaactgacgacattttatgtgtacgggtttctcctgacgatagatatctagccatctcgttgctggataatactgttaaggtattctttttggactcaatgaagttttacctaagtttatatgggcacaaattacctgtactatctatcgatatttcatttgattctaagatgattattacgtcttccgcagacaaaaatatcaagatttggggtttagattttggtgactgtcacaagtctttatttgcccatcaggattcgattatgaacgttaaattcttaccacagtctcacaacttctttagttgttctaaagacgcagtggtgaaatattgggatggcgagaaatttgaatgcattcaaaaactatacgctcatcagagcgaagtttgggctttggcggttgctactgatggcggctttgttgtttcttcatcccatgatcacagtataagaatctgggaagaaaccgaggaccaggtatttttagaagaggaaaaggagaaagaacttgaagaacagtacgaggatacattgctaacttctttggaagaaggaaacggtgatgatgcatttaaagctgatgcatcgggtgaaggcgttgaagatgaagcatccggtgttcataaacagactttagaatcgttaaaggctggtgaaagacttatggaggcgctagatttaggaattgctgagattgaaggtttagaggcatataacagagatatgaagctatggcaaagaaagaagttgggtgaagcgccaataaaaccacagggtaacgctgttctaattgctgtgaataaaactcctgagcaatatattatggataccctgttaagaataagaatgtctcagttagaagatgcactgatggttatgccattctcatatgtcctcaaatttttaaaatttattgataccgttatgcaaaacaaaactttgctgcactctcacttaccattaatttgcaagaatttatttttcattatcaaatttaatcataaagaattggtttctcagaaaaatgaagaattgaaattgcaaataaatagagtaaagactgaattaagaagtgcattaaaatctaccgaggatgatctaggctttaatgttcaagggttgaaattcgtcaagcaacaatggaatctaaggcataactacgaattcgttgacgaatatgaccaacaggagaaagagagtaatagtgcaaggaagagagttttcgggaccgttatataataaaactattatcctacataataccggcattactctgcccttttcacacttcaaaaggatagattaaattatctgtatattatacaattccaatcataaaaattgtcattccgattgcccttcggtaataatgggcatatccaaataacggaatatgtgttttttatacttattggtcgctgacatatgctgttttttgcgagatgtctctcgtctctgcagagcagttgtaaaattataggtcatgcatttttttttttttgataatgaataactatctaatctaacaaaatatacgtgagatactatgcccatttccctagaagagccattaaagcagctccacaacacatgatgagatatgcactaagcatttttttgaggccatcaggtcctttgaattgattagagtataagaattcatgagccattaattcgactagtccagtataaataagaattcctgatgatatcgagtcaaaaacaccattagcaattaatgctcttctagagccaggtatccaagagtgtctgacaccaatacctaccgcgactgctatgggtgacgttaaagtgaaggctaatcccattaaccaaggcatgtacttcttactttctggccaattcgtttcggcaactcttgtgcctagacccaaaccttcgaacatttggtggaaagttaaaacgataaataaggtttcgaattcttcacccgcgacagatagcgaaagacccacaaatacagagtgaaagatgatgccaaattctagaataaaaacagctagtatctgattgagatactgctctttatcttcctcctcgatacgtgtggccaactgggagacatcttgatggtcattttcgtgagaataatgatcttttccaggtacagaagcgagatttgtcgcatgggaactggttggaactagttcattagctagtgactctgtttttcccggttccagatcataattagtaacatttgagccgggttctttttcctttataggagtagcgacaatctcttcatttctagtagtgtacggagttttgtcattatggatggagtaggcagcttcgttattgaaagatacaggatccgagtccatatttctgatgacaaatcccgaactgggagcatcaacatcaatactggtaacttccccatggtccccatgatcgtgtcccagcgttttcgctacaaaataatgcgtgatgatttcagtgaagaaaagtaagaaaagcgacattaaacagatcccaaaagcccatggatattcggcaaatgtgccaccaagacattcatctcccagagcttcggctgcgggctgtagaagatgaacgaacgctgtggcaacaatgacaccagaaccgaagaacttcgctatgaaaaagcaccaatttggtagccttataaacgaataccgtgatgacaaaattgggaaataaactcccaatcctgacgatatcagtataatgaatactgccagaattctaagacctgcgtgcccattgtagccgttagaagcttggcaagtatctacggagtcatccctcgctataagatcaaccatactttcgaatatgcagtgtcacttggaaacgcctgcaatgttttctttggttgatgcaccgttgtattttcggagatcaactttagctttcttccggtctaaccaacagggtgtatgattcaataaacagtatcatcatatatagtgggttttagatcgtgtctcccaaaaggttgcgtcatttaaaatcgtcacactgtgttttaccaaaggatgtgtgaagctggtttgtagtagttaaagggcaatgtaccctaaaggttgtgaaaaattttcattttcgagaaggagtcgcatataacctttagggttatgtccctataaacgatgactattgccttttttggcccttaagactacagtgtacgtaaatcgtaaagaaataaatgtattatattattgttactattatttattatgttaatatcatgcatagataaatgttcgtcagagagcatcagtttcgtttgaaagggtgcggttcgagttttgctcgtgcgctgctgtggatgggggtggatccagtaatccatgtttgcgcatatcatctcgcagctgttcctccattttcattaggacgctcccatctttatcccgggcgatagtttcttttacgggacttgtgtcatgcgggctgtcaagcaggctttttttgggagatgtaagtttcttgttgatcgaatgttctaatttcttaccgccggtgcaaatcatccgacttctatgcaccattagagcatcctccctattaaatctctttccgcatgggcagatgtatttcttggcattatgggagattttgtgtcttattaaatcatgattgcgaacaaacgccttggtgcaaccgggaaagtcgcatgaatacggtctatcttgcaaatgtgtctgaatatgcgaccttatgttgtatctacgcttgaatactttgttacagttagggtataagcactcgaatagtttgtcgggtagttccttgacgtactggtcaatggtacccggaggcagagtagttggtttcttggttattttcattggcgtagtcctaggtattatttcatctggtaaaggagacgtactatgcaaagtggggcttttgtgaatatcatgtgtgacaggtggtacttgcggatagctttccacttcacagtgactgttatttcgtatgggtgtcttaatttctaactgatgatctgttaaatccggtgcatttagaagcggagctaggttacttccgttctttggtggagctttgacgggagtatgttgaaatacatgtttttgtggcaaagaattcttaattggagtgttattgctggaaccaggaataggaggtagtacacttgatgacgctaaagcgtttgcatttcttaatgttgggttctgggtatttcgcatgtggatgggttcagtgtcatcctgcagttgtgatattgtcgagaccgtggaaactacggattcccttttcttgtggataggtgacaactgtgttctaggcgtgaacgtgccagcagcatatcgatcatccctgcttttatctgtgccgacgaggaagggcgatctcaaactatttccatttatccttggagagatacttagcccacccggggaagtcttttcgaacagacggaatatgttatcaccagtactattttttttatcattattgtttttatcactggtgttattatggtcattataagtcaagccgtccaagtttaaattataattttgtggagaaaatgaaagcagttcagaatctctcaaataaccactgttagaggaaaaaaggttcaatccattactttctgggcttttatttggatatcgttgcctatggtatttcctggatggtgaaccatttattgaagtatttgacatccgaggcgatattaacgtcggaggaggaaattgatatccgccatttgcagagttcgttgtgacgattatagcattatctttcattctaccgttttgcatggcaggtgtctttagtattactggagatccaggtttggaattagaatttgtagccccagaaaccaacttctgcgccacctcttcttgctcttctaatactttacgcaacttttcttgctgtatttgattgtctctcaactgcttctccaatttttcgttcacttccttttgtttttcaagagcaattcttaactcctcctgctgtttcaacaaaacttggctcaaatagctattttcaccatcattttcccttatatggtcaaagtcatcattgttattttttaccgtattatgattacccaattcatttatgagttccatgggttgcggatctttagacatatttagaatggattgctgtaaactggaaatactcaatgtcttattatggccgagaaatccaaatatcgctgtgccacttagacctctcttgtgtgaggacattgattttttgctatagtgggagactttgttgttttcatcaccaaggttccaagttctatcaatattctttttatcagaagaaccatcgcccgtcttaggagaaggcactaaaggaatatccagatctcttaactcttgagtcaacaggtcatcgatgttatagtagtccatacctaacaagttatcgaggccatcatcgttttcattattcaaaatataattgtcgggtgggggtatggtaggattgacattatcatgatgttgaacatactcctcatcttgagtgtctttcgcgaagcctgagggatttatataccacggatctacaacgttatccatgattgtattaacaccgtttttggtcctatagatttctttagttatttcttgaatttatgccttgtatttttttcttctagcactttaactgttgcttgagtctccctgcaacgtagcttttgtttgctaggtacaatgccgagagaggttgttataagtttatgtgtactataaaacccttaatgaaagaaaagggacagaaatattgcgagtaaacaaacagtactccctccttaatatttgcccgttaatggctaaatgctttctggagttgatttactagctacaagcatccttatcctttacctgtaaaccaaaagtgtcctgaaattttcccaaagtgccaatgtttacattttgccgttttgagatatatatcgtatattatgacaaccttcacctatctgacgagccgctctcagtgccccggtatttttgggcggctattcctataacactattagttaaaagggattctaatggagtgacggttttcatcacaatagatagagttaactaagaactctagtttgtatgcaaagtcattattgagtagtaaaagcgcccccatcgtctcgtttaattgttgataacgttttaatgtggcttttgaagggttgctagcgatggcaattgaaacatgtaaattttgcctacttacaattaaatcctgatagtttgaaatgcctgatttctgaagtgcctcagctattatcgttttgaaaggagaaatttgtgccttattgggacattctgagacagggagaccgaggtacaaggtgttggctcgttctgatatatataacttcggatatgagcagatttgaagtttaaaaggggttatttcattatttcgtaaaccattacgcatttcttgaatgaaaacatgtctttgttcttcagtttcaaacaacaacgatcgagttaaggaaacgtgtaaaggtttgggggctcccaagtgtgagatgaacaacgggtcaaaatccaccagttgatacggattagtgtattcctgtttcataaatgtttctttatatttacatatgattttctgaagttgtcggtgaatcgctggagtcggacgccactcaaaatatgtgaacgaacgccaaaatcgactcatattcatatcctggtgctcgtacttttgtaaattcggagggatgtggtacttcaatataattgaatccggtattgcaggtaaatcagtggaatcggctttctgtatgcaagttttctccgtgtattcgatttggacctcacttttgttactactttcgctctcggtatcactaccgtcactgctagaatagtctgcagatatgaattccataggccagtcttcttctaagcgattggtaacctccttcactttagaacaccaccaacagatcgttctcttgttctttgttctttatggtataatattcacatggtgctctaccgtttttcttgtcggcccagccggttaaatctcgaagagacagaatagaagctctgtggctgtaagtaaggataagccaaatggaaaagttatagaattaggacaacaatatacagtttttttttgtactcttatagaatacacacacatagatacgcacgtaaaattagagcaaaagatggtacaagaatcacgtccagggagtgtaagaagttactcggtcggttaccaagcaaggtccagatcgagttctcaaagaagacattcgttaacacgccaacgttcctcgcaaagactgattagaaccatcagtatcgagtctgatgtgtctaatattactgacgatgacgatttgagagctgtcaatgagggagtagcgggtgtgcaactggacgtctctgaaaccgcaaataagggaccaagaagagcatcagcaactgatgtcacagatagtttgggttcgacttcgtcggaatatattgagattccctttgttaaggaaacattggatgcaagtttaccttcggattatctgaagcaggacatattaaatctcattcagagtttgaagatatccaaatggtataacaacaagaaaatccaaccggtagcacaagatatgaacttagtcaagatctctggtgcgatgacaaacgcaattttcaaagttgaataccctaagttaccatcgttgctattgagaatatacggaccgaatattgataatatcattgacagggaatatgaattgcagattttggctaggctttcattgaaaaatataggtccttccctttacggctgttttgtaaacggtagatttgagcagtttctggagaattctaagactttaacaaaagacgacattagaaactggaagaactctcaaaggattgcaaggagaatgaaggagttacatgtaggtgttcctctcttgagttcagaaaggaagaacgggtcggcttgttggcaaaagattaaccagtggttgcgcacgattgagaaagtcgaccaatgggtgggggatcctaaaaacattgaaaactctttattatgtgagaattggtccaagtttatggatattgtcgatagatatcacaagtggcttatttctcaagaacagggtatagagcaagtcaacaaaaatcttatattctgccataatgatgcccaatacggcaatttacttttcactgctcctgtgatgaacacaccgagcctatacactgcaccttcgtctacatcattgacttcccaatcaagttccttatttccttcgagctccaatgtcattgtagatgatataatcaacccgccaaagcaggagcaaagccaagattccaaattggtcgtcattgattttgaatatgcaggtgccaatcccgccgcatatgatttagcgaatcatctttccgagtggatgtatgattacaacaatgctaaggccccacatcagtgccacgctgatagatatcccgataaagaacaggttttgaatttcttatactcttatgtttcgcatctaaggggtggtgctaaggaacccatagatgaagaggttcaaagactctataagtcaatcattcaatggagacccactgtacaactattttggtcgctctgggccatcctacaaagtggtaaattagagaaaaaagaagcctccactgccatcactagagaagaaattggacccaatggaaaaaaatatatcatcaagactgaacccgaatcccctgaagaagactttgttgaaaatgacgacgagcctgaagctggcgtcagcattgacacgttcgattatatggcttatggtcgtgacaagattgcggtcttttggggcgacctcattggcttaggcataatcaccgaagaagaatgcaaaaatttcagctctttcaagttcctcgatactagttatttgtaatacgtatacgaattccttcaacaaaggccaaggaaataaagcaaataacaataacaccattattttaattttttttctattactgtcgctaacacctgtatggttgcaaccaggtgagaatccttctgatgcatactttatgcgtttatgcgttttgcgccccttggaaaaaaattgattctcatcgtaaatgcatactacatgcgtttatgggaaaagcctccatatccaaaggtcgcgtttcttttagaaaaactaatacgtaaacctgcattaaggtaagattatatcagaaaatgtgttgcaagaaatgcattatgcaattttttgattatgacaatctctcgaaagaaatttcatatgatgagacttgaataatgcagcggcgcttgctaaaagaacttgtatataagagctgccattctcgatcaatatactgtagtaagtcctttcctctctttcttattacacttatttcacataatcaatctcaaagagaacaacacaatacaataacaagaagaacaaaatgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataagctaattaacataaaactcatgattcaacgtttgtgtatttttttacttttgaaggttatagatgtttaggtaaataattggcatagatatagttttagtataataaatttctgatttggtttaaaatatcaactattttttttcacatatgttcttgtaattacttttctgtcctgtcttccaggttaaagattagcttctaatattttaggtggtttattatttaattttatgctgattaatttatttactttcgtattcggttttgtacctttagctatgatcttagctaattgaagagggtggtgtgatctttaaccataccttattatctttcagctgcttaccattttcttatattgatttttagcgaaagatttttattcacaagctttttttatccttaatgctcgaatactacaacaaaacaaaaaacattaaacagtttttaattttgtgaacaaactgaattacaaggccttacatcttatttagaatatattaagaaacagaggccaacatgccttcttaattatattgatatggacctctgtccttcctaaaaacgggtttttgttcgatgaaaaatcaccagtagagcaccatatatgaatttacaatcattgtagggaaaagaaaacttgttctgcttcgccaattgatttcatttctttttttcctttgtttttgttgtatactattaatatgcgtagttctttgtcacttagtggttttttgtttaatttataacgcgaaagctgcatactaaaaatatagagatgaatggaactccgaacaagcaagagagatattatctatctctgttccataataataaccagtagttcagttggggaacttaataatggaacttcagagggcacaacggaatttgaagtttttacaaaacgaggattatgtgaacgttaccgatcaaactaacctgaatggagagagccagaatgcttactctttaggaatggaaactcaagtaccggaaatgcagttttccttatcatctgatgatgattcaataggtacgcaagtaaaaagcgtaactgcacaaaaatcgcctatgacgcaagagactacgaaaaacgatacagaaagaaataaagatgttgataaaagttgtaacccagtcagcacttcccatcccgatttaggcggatcaaatatcgaggagaacatattcattaacactcaaattcaaagccgacttgatgacgcagaggaagaaacaaatcttaagttaaaacttgaaaaattcaagtattcgttcaagagtagtaacgcagatgatacccacagcaatgcaaatgtaacagctaaaagaagaccagcaataaggaaggctaattcgaaactcaaaacaaaacctaaaactaaacgagaccctaaaattatcaaaaatataactgatttcaatattaataactacgaacgttcaaggactgccagcttattaaagcaattatcaggtaagcacaagaaggttttggacataataaagacgcaaaatgaaggaaacagtgataaacctcccagagcaaggaataacaagggtgaaaaagctacttttgatacatatagtgaacaggagtggaaagatattatgaaacttcttctacaaaagtttccgcaaagtgaggaaacggatttgaatgaagtccagaaatttttatatggaagcgaaaaaagctcgaattctctagacaatcaagaatcctcacaacaaagactttggacagcatcacaattaccacccgagcttcccgatgaggctattcaaccagagcaggaagaaaggatacgcgatacccaaagtgcagtaaatttcttatcgttgtctcaagtaatggatgacaaaagtgaaattatgaaagacgaagaaagcataattatttcacggggagattctacaagctctcaagaatatggaaacgggttagagccacaacaaccggtaggaaatgttgttggtgaagatattgaactggctgtgggaacacgtataaatgcattttcactgacagattataaagcttgcaaacctatgtctgttgaggtaagtagaagatgcgaaaacagtacggataatgattatgacaatatttctattgtctcagatactacagatgagacatccacattgtttccactagaccagtatcggtatgttttcattgaaaatgatgaaagaccaccattagccaccgacacgataggcagcacacagtttttcactccaaacacatcgcctttggatgggataatcgatttaacacaggaatcattcaaagctgttcgatcgttaatatcacctttgaaagtagaaaacaacaaaacaggggtaacatcacaagcatcaaatcaggttcaggtaccagctacaagaacccctacaattattcctcaaaagaaccttactacaactttaaaaactgaagaagaaaagaataacataggaagttccatcagagttaaattattgcaagaaagcgtagttaagctaaaccccaaactggtgaaacataacttttatagagttgaggcaaatgattctgaagaagaggagacagaatttgatgaccaattctgcattgctgatatccaattggtagattcctccaaaatttcgactaaagattctacacaaaatcctactactagcaacgacattattgatacctctgcagctagttccatagcttctcccgagaaattttgtgagatcatgatgtcccaatcaatgaaagagcttcgacaaagcttgaaaacagtggggttgaaacctatgaggacgaaggttgaaatcattcaatccttacaaactgcatctcaaattctgtccacagctaatccagataataaaggtgagcatggtggggtggcaaatttcagtaagatagaaatatttgatcatttaaccgaactaattgaagccttccctgattttttggagcgaatatatacctttgaacccattccgctaaatgagctaattgaaaagctgttcagcgccgagccatttgtttcgcaaatcgacgaaatgaccatcagagaatgggccgatgttcaaggaatatgtctgagaaacgataaaaagtagtgccgaatgattgagaatttgacaaaacaaaaacaaaacaaaacaaacgttacgtatagatgaagaatacacgtacacaaatatgcatatataccgtcatgaagtagcttaacttaaataaaagtttttttttttagagttaccaatatcgcaaacatgaaaatgagaataaaaaaaaaaaagcagaaaaaaaaaaagcataacatggagaaaaaaataataaataattgagtttagttgagacgccggtcttcgccaggccaggaattgtttcaccaggtcattctctgcaaagcctttactttaacatttagattcttcttcttggcggagccgcgaccattgcttctcttttcgtctgattgtttgctagtcgaagagacgttacagtaagtaccagctttcacgtaaacagcaatgtcgttgtcgtcgccatgtttgaagcagcatcttctgccataaggacaataacctagtttctcccaattcacacagggcttcgtcctgaaattcttgcacgatttcttaacctttaattcgccgagtccgtgagcaaactgacacttactgccataagggcaacttccttttaaagtgaatgattcgcacagctctgtcttgtataattgtttgggagtttcctgcacttggcttttcaccttaggttgagctgaggattccttctctgatgaaaaagaagcatcatttttgggcttttgttgagacaactgttgcaaattctgtgaagttaatggtaattgtgaagattttgggacatagtccggatttatttgtacctctagtttctttttaaaagtagtaggtgccgtgctattcaggtgagcggatgggagaaaagggttcattaactgtggatcatacagtagccccggttgaatagcgtttgtattttttggtggagagaatgaaactgccgaagatatttcactgcttgtttcctgtatgttatcctcgtttaaaatcgtcttgttgtaatactcctccagttccctaatattgatctggtactggtagtcatttaatggattttgctcttgatctgtggaaaacaacgacgttaagtcagtcttctgagattctggtctagtatatgataattgagcccacatattgcgttattttttacgtattgagtttgcagcactgtttcgctttctctcaagatgcacaaatacgacctaccaagagcctccaagtcccaccaacgattatgtcttctctcaaatatatatacaagttacatgtagagaaatcgagacgagattgctggcacaatgcacccaactgcatgtgccattgtgcatctacacctccaaattagggtgtcgattggcgtcgtcttctttaatgtgggtgcattttgcggcggcgcgacaaatatagagaactgaccaaggcagtgctgtcaagaagagagaatggttacggcagcgaagacgcaaatgggctaggcagaatggcattcaagttatggctactggatgaggaaacaatatacgagcacgtgttcgaacggtacacacaattggagggccagtccgggaaactggcgcaggatttgggtattcaggatagaaggggcggtgtgctagagataacgtttgaaccctctgggctggaaggcggcagaaaaaaaaagcgagtgagaagaagaaataaggctagtagtgttgaagaagatcagaatgttgctgtggatagctatcatgttagcgtggggcagtccatatcaagcttgcgctcgtccagagacaacggaaactccaccacaggatacgttttgtggtctaccacacctttcttcatcaactggctgctgtatagtactagcgctgcacctttccgtcttgggagtcaggtggaagtaacctgcgggtcttcttgcgaggggcacaagcttgagttgcccaggctggtcgacctcacgggcgctgatcgcggcaagagaggtatcttggaacttggagcaggaatatcaggtattttgcccgtgattcttggtaacttcgtcgacacctacgtgtcgacagatcagaagggcattcttaataaattaaaagataacatcatggaaaacttatcacagttgaccagaaagcggtgcatttcccgatcactaagattggaacttcccaccgtcgaaccagttggcgacgctgatatcaccgcagcgtcacttccatctaagtttacgttgcatttggaagtagccgctctagactgggagaagataaacttgcaagacaaaaagacccactctctgcatcctgagttgtcactcataggtgaaacatgttcttccgtgtacgttatagctatggatgtcatatacaacgagtacctgatagatccgtttctgaagacgctcaagcaactcaaacactggttacaaactacctacaatttgcaattccatgtcctcgtggggatacacttgcggtcacaagaggtgacaacactgttcttggagaaagccatcatagaatatgacttcacggtttatgatatcgttgaccaggtcatacaagagtcccgttttaacttttatcttatcacctagtcccatatataataatagaaacaatataatgctgataatcttatttttctttgcgatgcggcagtgcctcttcccctccgtacggattgggaagattttcatttttgattagcaagggcactaagccaactctgtgtgatatagctaataatctaaaagctgctggatccgttatcgtcaagataaagcggacttagcgatttacataggatcacactttctacacacatttgatttttaagcttcattttccactgcacttatttttcccaagcatcgtgtttttttgtacattataaaaaaaaatcctgaacttagctagatattatggctatctgggagcaactagaagtctcaaaggcgcacgttgcttatgcatgtgttggtgtcttttcatctatcttctctttagtgtcactttatgtcaaggagaagctttatattggtgagtccaccgtagcaggtatatttgggctaattgtgggtcctgtttgcttgaactggtttaatcctctgaaatgggggaattcagacagtataacattagagataacgagaatagtattatgtttgcaaatttttgccgttgccgtggaactgccacggaaatatatgttgaagcattgggtatctgtgacgatgctattattgccagtgatgacagctggatggcttattattggtctcttcgtttggattcttatacctggcttgaatttttctgctagtttgttgatatctgcgtgcattaccgcaacagatcctattctggcgcagtcggtcgtctccggtaagtttgcccaaagagtacctggtcacttaagaaatctactgtctgcagagtcaggctgcaatgatggtatggcctttccttttttatttctttctatgaatttaatcctacatcccggtaatggaagagaaattgtcaaagattggatttgcgttactatcctgtatgagtgtttgtttggatgcttgctaggttgcttcattggttatgtaggcagaatcaccatcaggtttgccgaaaagaaaaacattatcgatcgtgagtcgttcttagcattttacgttgtcctggcgttcatgtgtgctgggttcggctccattttgggtgtggatgacctattggtatcatttgcagccggtgcgactttcgcttgggatgggtggttttctcaaaagacacaagaaagtaatgtttctaccgtgattgatttgctactaaactatgcgtattttatctattttggtgccattataccttggagtcaattcaacaacggtgaaattggcacaaacgtctggcgtttaattatactttcgatagtggtcatctttttacgtaggatccctgcagtcatgatattaagacctcttatacctgatataaaatcgtggcgtgaggcactttttgtgggccattttggtcctattggtgtaggtgcaatttttgccgctatactagctcgtggagaattagagtctacctttagtgacgaacccactcctttaaatgttgtaccatcaaaagaggaaagtaaacattggcagctgatagcctgtatatggccaataacttgttttttcattgttacttctatcatagttcatggttcttcagttgcaatcataactctaggtcgtcatttgaacacgataacgttaaccaaaacattcactacacacaccaccaatggtgataatgggaaaagttcatggatgcaaaggttgccatcgttggataaagctggacgatcattttcattgcatcgtatggatactcaaatgactttatcaggggatgaaggtgaagcagaagaaggaggaggtcgtaagggactagcaggaggtgaagatgaagaaggattaaacaatgatcaaattggtagcgtcgcaacgagcggaattcctgcaagacccgctggtggtatgccaaggaggaggaaattgtcaagaaaagagaaaagattgaacagaagacagaaactgagaaacaaaggtagagaaatattttcatcaagatctaaaaatgaaatgtatgatgacgatgagttgaatgatctgggacgagaaaggttgcaaaaagaaaaggaagcacgcgccgccacatttgcattgagcacagccgtcaatacacaacgtaatgaggagattggaatgggtggagatgaagaagaagatgagtacacaccggaaaaggaatatagcgataattacaataacacaccaagttttgagtcgtctgaaagatcttcatctctccgaggaagaacttacgtaccaagaaaccgttacgatggagaagagacagaaagcgagattgaaagcgaagacgagatggaaaatgaaagtgaaagatcaatggccagtagtgaagagaggagaattcgaaaaatgaaagaggaagaaatgaaacctggtactgcttatttagatggtaatagaatgattattgaaaataagcaaggtgaaatcttgaatcaagtagatatcgaggatcgcaatgaggcgagagatgacgaagttagtgttgatagtacagcccattcaagtttaactaccacaatgaccaatctatccagtagtagtgggggaaggttaaagagaattttaactcccacatctttaggaaagatacattcattggttgataaaggaaaggataaaaataaaaacagcaagtatcatgcatttaaaatagacaatctgttaatcatcgagaatgaggacggtgatgttataaaaagatacaagataaatcctcataaatctgatgatgataaaagtaaaaaccgcccaagaaacgatagtgttgtatcaagagctttaacagcagtaggactaaagagcaaagcgaacagcggcgtaccgcctccagtagatgaagaaaaagccatcgaaggaccctccaggaagggcccagggatgttaaagaaaaggacattaacacctgcgccaccgagaggagttcaagattccttagatctggaagatgaaccttcatctgaggaggatttaggtgatagttataacatggacgatagtgaagattacgacgataatgcatatgaatcagaaactgaattcgaaagacaaagaaggttaaatgcgttaggtgagatgacggcaccagcggatcaagatgacgaagagttgccgcccttacctgtggaggcacaaacaggaaacgatggtccaggtacagcggaaggaaaaaaaaagcaaaagagtgctgctgttaagtcggcgctatcaaaaacgcttggtctcaataagtaatttattaatacacaaagatatattattttagtatatatataaacgaaatgccttttttatttacatgtgtcggaaatagagtagatgcggtaaagagggggaggggggggggtatgcggttttgtcattactcttttccgttaaacttaaaagcttaaaacatcattgataaaggtttttagtgaggtttcactggggttcacattgatgaaatctaattgtctgtaggagccattgttcaaaaatccgcggctgatatctgaatattgaatgatgtatttatcatcttgggcagtgttcgtaggaaatcgtaaattcaagacacgatgggtcaaaacatcagtcaattggtattgctgtattaggttatctggtaaagaaatgttgatttttttcataagattctgatatttgtttaacttccagtgtgacttgagaagaaattcttggaggcctttttgttcagataaccaagcatccggattggtctggtcgaaatcaggtaaaagatcttgaatgtaatctgacgtgatcttatagtctgtctggcattgtggagttcttaagataacagaattttcttgtaatttcaaaagaggcctcattgaggtggtaacaatgttatcgaattcgtcaatctcgaaccaaatctgcaaaaaaggggacgaggaggagccagaggtgggcggcacaggagtgaagttcagctgtatgaaggattgatgcgcatttgttattagatgttgatcaagaggcacaggcacaggtacggctgatgatgatgattctttgtacattggtagattcagtaattttgaaataaaactcttatgtattagaggttggaaaatactagaaaaagacgcggactgtaaggagtgacctagcgttattgataaagattgggaaatagagtcggaaggggagagagatggtatatttttagacaaggaagattcgaattggctgacctgcgcatctgtcaattctggtgtggcgttttcagtgggagtcatcagatctgtgcaatttttagggacaactgactgtaatcttgcccaatcttgtgacttgtttagccagtccaagttctctagagtattgttgaacggatagagttctgtcttgagtgctggtgaggctattgtgtggtggtgttgagttgtgttaggattagaagcgacggcatttaataaaaagactttggccatggatattttcttggtgcttagggctgaaatcttgtacatttgcaagtccgggaggtattcaaaaaaagtgtgagtttccttctgaataaggttgatgacgtcttttgatggcatgagggaatacatacgcacattttcatgagtgatgtttgaccatattttgtttaaggatatttctgcgtatttgagcaagctaggcgaacccttgacggtcaattcgttatcctgaatggagatgatgaatgtcagcccgagcttattgaagttggtgagtattttaccattttgagtgatgagtaaaaggaaaatttctctaggagaatcgaactggaaagtcaatgatgtggacttgatgcctgtgggagtggtgggtgttgaaattggttggcaattccagattttttcaattatatattgggacagcttgcttttcttccagtgcgtcagatgtgaagaggagtctggctgatgtgtggagatgaactcgcgcagttggtagcgattgtagcttgatgtaagcgattggagaagggcattgtattccagggagggcagactggcgcttgtcggtttcttcaatcggatggagttcaatgcggaatctagtgaattctgcttttcgaagacaaggagtttcgagccgaaatcgaggttgttatctccagtttccttatggctacgtttcttagacggcctgtgtctaggctgcttctgatcatttttcactagcccagattgggtagggttcaagacgacgaatttcagattttgcggcagtttcttcttcccatgaaggggcgagcttgggcctgagcttgaataaagacggtaagtaagacgggcgagctttttgttgaatttccacatatgcttactctatattttctccagtgccttcaagctccgtatatattatgtactagttttattacattaaagatacattaacttttttttttttttctagttcactgaaataagaaaaggcgggcgaggtgaaaaacaaaaaaaaaagtatagagaaacagaagtggaagaagagctaggaaagcacagcgcatacgacggtcacctaggatggagcaccaacaattgcggaagtacgtcgaattgtacaataaggaggtcgaggaattctacaatggtgccgcgtcaggccgcccagctgagttccatccttccaaagtacatgtaaagagcatccatgaaaaggcgggtaccgccaatgctggtgtagaaatctctagcgttggtgtagactgggacagcgaggagaagaatacctttttctggtgcctttcacgctatagtatccaccgtgtagacgagtggcgctcattgttgcctcggaagagcgccatggagattctaggttattacaggttgttaaggagagcgagtgcgagcgcgagatcgcgtaaggcgggtgacgacggagcgcccattgcgtacgaaatgagcgctgagtgggttgccctggagacaaaactgagcgagacagtgatggccatcacggaaggcgcagccgaggttgccgatgaggaaggacactgcgagggccttatcgattatgaaagctggaaacgcaggtgggtggccatctactcgcacagccgtatcgcggagataagacccttgccccgccacgcgctgccgctatcgcgcagcgcgacgcagactttggagcgctgcgtaagtcgctacacacgtacattgctgtggtgcacggcccttgcgggtatggcttcccgcagcgtcagcgccagggcggccgaatctcgaggacacaagtcgctaccgacggtggtaactcgccggcaagttgagcgtgcactatgcacagaagcccgatcacgtgacctacacgtgcttccaaggcgcattgttttgacactgcgcaaatgggaactagactatccgcgagagggcaaactgttccgcaccaaggagatggcacatctgtttctacaaagccagttgtccagacgggatgcgcccccagtccatcaagacgaaaatcaagaaaatcaagaaaatcaagaaaatcaagaacaagataacactgcaagtgaaggtgaaagcgaggcagaaagggatgaaatcgacgaagcggacttgttccgatcagcattacatgaaaatcagttgctaaaatggttatccaaatgagacacaatgcgaaaaatcgcgcagggacataatttttgttttcattattctttcgcttattccctccgttagctccaccgcttttttgattggaatttcctttcggcaatggctttccggttaccacgcctcgggtttcgcatcccgaaaagcatatctacacaagaaaaatgaatgataaacaattgatgagtggcgctatttcccttatcatctcattattgtacttagtatcgtctattatcaggagaaatcgcatgaactaagcccattttctcacccttctgccttcttatataaagcttgctgggaaccgaacacaaactccacaagtccgtagcagctcttctcttttgtcttttatatatcataaacatcgctacatagtaataacactaacgcacgctagaaatgatagcttccaaaagctccttattagttactaaatcgcgcataccctctctatgctttcctttgataaagaggtcctatgtgtcaaagactccgacacactctaacacggctgctaatctgatggttgaaactccggccgccaatgccaacggcaatagtgtgatggcacctcctaactcaatcaattttctacagacacttcccaagaaggaactattccaactgggattcatcggtattgcgaccttgaacagcttcttcctgaacacgatcattaagttgttcccttacatccccatcccagtaataaaattcttcgtctcttctttatactgtggcggtgagaactttaaagaggtcatcgaatgcggcaaacgtctgcagaagagaggtatatcgaacatgatgctttcattaactattgaaaattccgaaggtacaaagagtttgtccagtactccagtagaccaaattgtcaaggaaacaatcagctctgtccacaacatcctactgcccaatattattggccagctggaatctaagccaatcaatgacattgctccaggttatatcgctctaaaaccctctgctttggtcgataaccctcacgaggttctgtacaatttcagtaatcccgcctacaaggctcaaagggatcagctgatcgagaactgctctaagattacaaaagagatttttgaactaaatcaatctttgttaaagaagtaccctgaaagaaaggccccatttatggtttccactattgacgctgagaagtatgatttgcaggagaatggtgtttacgaattacagagaatcttatttcaaaaattcaatcccacttcatctaaactgatatcatgtgtcggtacttggcagttgtacctaagggactctggtgaccatattttgcacgaattgaagctggcccaagaaaacggctataagcttgggctgaaactggttcgtggtgcttatattcattctgaaaaaaaccgtaaccaaattatctttggcgataaaacgggcactgacgaaaattacgatcgtatcatcactcaagttgtcaatgatttaatcatcaatggcgaggattcttattttggtcacttggttgtcgcctctcataattaccaatcccaaatgctcgttactaatttgctaaaatctacccaagacaactcttatgccaaatcgaacattgtgttggggcaattactaggtatggcagataatgttacctatgacctaattaccaaccatggcgctaaaaacataatcaagtatgtcccatggggcccaccattggaaactaaagattatcttttgagaagattgcaagaaaacggggatgctgtgagatctgataatggctggccattaatcaaggccatagcaaagtcgattccaaaaagagtaggcctatgagaggactataatatatactccaatttcaaagacaaaccaaaaaaccaaaaaaaaaaagtaatgcatacataattctgatgttctagttatacatattatatataagtaatgataataacactaatagtaaagtaaacgcacggatatcaagagttaatatacttgaaccacttaaataacaatctgttggtaaagctttcttcctattgattatgggttcgaatagtaccagatgttttgccaatcctaaatcggtaggaaagtggcttgtcgtcgtcaggcttattatcaactcttatgcacaagaaaggtactcatcttctataaactacataagacctgaatctaatcaaagggagaaagcgcagaacatcagatttaaagcggttttgcttgatacactcagccttgtctctttgtaaggattttggggtacctatgaataatacatctagtagtgttagtaaaccaacgtatgggattttgggatacatagttttccagtgtttcttatccgtgatagtttaatggtcagaatgggcgcttgtcgcgtgccagatcggggttcaattccccgtcgcggagaatttttttaagcttctattaaagaagctttttttcacttatatctgatggatgatgaatagctagttcaaacggaaatctttgataaagctatatcaaaattcaaagcccaataagtcagtatcatgaagtttatagcattaatatcaggtgggaaggactcgttctacaatatttttcactgcctgaagaacaaccatgaattgattgccctgggaaatatatacccaaaagaatcagaagagcaagaattagactctttcatgttccaaacagtaggacatgacttaatagactattattctaaatgtattggtgttccactatttagacgctcaatattacggaacacttctaacaacgtcgagttgaattatactgctactcaggatgatgaaattgaagaactatttgaacttctaagaactgtcaaagataaaattccagatttagaagctgttagtgtaggtgccatcttatcgtcttaccagaggaccagagtggaaaatgtttgttccagattgggtctagtagtgctaagctatttatggcaaagggatcaagccgaactaatgggtgaaatgtgccttatgtccaaggatgttaacaatgttgaaaacgatactaattcaggaaataaatttgacgccaggataatcaaggtggcagcaattggattgaacgagaaacatttaggaatgtccttgcctatgatgcaaccggtgttacagaaacttaaccaactttatcaagttcatatctgtggagagggtggggagtttgagacaatggtcttggatgccccttttttccaacatggatacttggaattaattgatattgtcaaatgtagcgatggtgaagttcacaatgcaaggttaaaggtaaaatttcaaccgcgtaatttgagcaaaagttttttactcaaccaattagatcaattacctgtaccttcgatttttggtaataattggcaagatttaacccaaaatttgccaaagcaacaagctaaaacaggagaacaaagatttgaaaatcacatgtcgaatgctctaccacaaacgacaatcaataaaaccaatgataagttgtacatctctaacctacaatcacgtaaaagtgagacggtcgagaagcaaagtgaagatatttttactgagctagccgacattctgcattccaaccagattccacggaatcatattttatctgcgtcattattaattagagatatgtctaatttcggaaaaatcaacaaaatatacaatgaatttttagatttgtcaaaatacggacctttgccaccatcaagagcatgcgtaggttcgaagtgcttgccagaagattgtcacgtacagttatcagttgttgttgatgtaaaaaatacaggcaaagaaaaaatcaacaagaataagggcggactacatgttcaaggccgttcatattgggctccatgtaatatcggaccatattcccaaagtacttggttaaacgatgatgcaaaccaagtcagttttatcagtgggcaaatcggactagtaccgcagtcaatggaaatattaggaacacctctcactgaccaaatagttttggcattacaacattttgatactttgtgtgaaacaataggagctcaagaaaagttactcatgacatgctatatttcagacgaatcggttctcgactctgtcatcaaaacatgggcgttttattgttcaaatatgaatcatagatcagatctatggatggacaaatctgatgatgttgaaaaatgcctagttcttgtaaagatttctgaattacctagaggcgctgttgcagaatttggtggtgttacttgtaagagattaatagtggacgataatgattccgacaagaaagaaagggaagagaatgatgatgtttcaaccgtattccagaaattgaatttgaatattgaaggttttcataacactacagttagtgcgtttggatataatagaaactttattacgggatttgtagatagtagagaggagttagaacttatcttggaaaaaaccccaaaatcagcccagattaccctctattataatcccaaagaaatcatcactttccaccatcacattggatactatccggtggagaaactttttgattaccgtggtaaagaacaccgctttgggttgcatattcgttcctaactccaaatgtaggccttatattttataaacttaatagatatacgctgtccacgctcctggcggtgtaaatgatagacagatcccaaatatgttagcaaatcataggaacaacaccatattgtgaacacgtaaaatttagaatacgccgcacaattaaggtgtgttctgtaataatttgattattgatgatggtttaggaaccaatattcatataaaaaaatgatcattctataaaataccttatcgtaacacttgtaccatgctactaacactgtatatatttctgacccctaagaaaaagcacctgaataagctaaagaccaagttaagctttgcccattgtctaggaaatttctgttgaaatcaggttggctgaaaaagtcgtacgaaaattttggatcaagcagagccatatttaacatgattattcctttccaaccgtcattcacttgatcaattatcggctgcattttttcttcccactcctctttgacaaaatttggtgttctgacccatgaagatgctgatgttataggaatggcgtgaatcatatgaatgtattgaggctccatgccaaaatacgtggcgtgatcaattttattttcgaataaaataccactaactttattaccaataaattctttcggttggacagtattattgctttcgtataggaagtagctctggaaaacatttctcatgatgccgagttgtaagttcgctatgtcagttaacttagaatttccagttaccaacccccacaattttatcgcatagcaagaattgacatcttctgaagtagattcttcatctttaccgtcaccacttggaaatagtcctttggcccatgaatggccattaaaccaatcaaatgacctaaattgagggaagtacggatcatcgttgtcaacaccagagtaatctctaattaagcactcaacccaatctctattattttctaaccaggagttgttagtaactccacttaaatcagaatcgactaaagagataatggcagccgttatgacatgataagagtaatgaaaatgatgatcattataataagagttaccaaagtcttggctagaagagcctgatgaaattatgcctttccaactaacgtcgtaatttaaaggtaagacttgctgattgctgatgaatctctccattgcaatagtcagtttagataataattcttttgttaaattttcatcatgaaggatgtaatgtgtcacataaagaatccacgcatactttgcaagtatcttaccagagaaatacatagaatctatgtttgattcttgttgagggtcactcaattgaacttcttgaacagcagcttcccgaattttagatagcttttcttgactgtaatctgccttcttattcaaagataacgcgacaggttcaaagcccaattcttgaggtacttgaacctgcatatcaaaactgtttgtgagataaccagtcattaagcctttaactgtggaatccaggcttgaggcaatttcacgttcctgcatttctggtgtgaatgccgctttatgatgtggtaaagcatacattagagtagttccagactgcgagtagcctgcaaccgtatagttaaatctgtaatttgtgaaatgttcatcaacagtttgccctgataggtcacagtatactggataacagcccgctgccatgtcaatactggggacggagtctgcagataattgacagataagaccattgattttatgagatgatattattgtattgctgtcgagtaatgaaatttgaaaatcttgtggaaaagagtaatcaggtgaggtcaaataaagtatccaattcctattattctcaagttgtatattatatttaccatatctttcattcacgcttatgcgctctaagctcctgaaaccaacggcgcttcttaattcaaaacccaaatcgtggtaaatagccgtgacaaagcccatcccctgaaccagcgggaattctataaactgggaactactcaaagacattagtaagcacatggacatatgtttcatatcccggaattcaagcttgatatcatttgaagagacaaattccctggccttgaatacaaatgattttatatttgtgggattgaagtagaatctgggaggatttgtagttgtatcaaaaaccctttgagacgctaaagtatgattggcggccaaaccaaacaattctggatcacgagaaaaccaaattgaataaggatgtgtccatataggttgtgtattatcgtctaataacatgtttgtgtagaacttgtttgtctccaatggatcaacagattgatcatcaatattcggctttggtaccgggtgttgaactttgttgaagacggaaggaggagcttttaagttagaaaggacaggtgattgaaaaatattgtcactattcacctggctgtcagctaaagggttagaactgcttggtgtgcgcagtgattcacctgccaccctattttctcgaggtttactggagttctcagaagaacaaactggtggctgaacatttgcgcgaggtggtaagggaggaggtcctctattggtagtaccgccaggtctattaggaacaggtggaggaatggcttgcctactgtaacacatctttttacttctcgtatttatttatttttgtttttatgatactagcacttttcagaaattcatgaattttatttatggttccaagaaaaaaacttcaaagaaatgagtactagaatgatatatccacaaaaaaaaaaagagcagaaacaaaatggatgagatggataatgtgatacgatctctggagcaagaatatcggttaatattgctcttgaaccataggaacaaaaatcaacatagagcggctagctggtatggatcgttcaatgagatgaaaagaaattgtggacaaataataacgctttttagctcgagaagattacaagccaaacgccttaaagatgttgaatgggtcaagttgcacaggctattacagagagcactttttagacagttaaagagatggtactggcagttcaatggcgtaattgcgctgggacaatttgtaacgttgggttgtacactagtaacattgctggcaaatgtgagggcactgtatatgagattatgggagattaatgaaactgagtttataagatgtggatgcttaataaagaacttaccgagaacaaaagcaaaatcggttgtgaacgatgtcgaagaacttggagaaattatagatgaagatattggcaacaacgttcaagaaaacgaactagtgataacgtctataccaaagcctctgacagagaactgtaagaagaaaaagaaaaggaaaaagaagaacaaatcagccattgatggcatattcggataaatatacaagtaaatagactttttaaaataataatatcaatgctaataaatcattcattaatgaccttgtctgcccaagtaggcaaaacaaacgcactagaatgtatttgaggattatagtacttcagcttcccttgttcttgctcagatatctttctttgcggaatgttcaacggtatattggcgttattactgcaaacaattaaacctaattggccagatgtataggttggaaccatggtatagcaatattctgtattaggaaatacctttttggctgtatttttcaaatcatgtaagtattttaaatttaaccaaaaattttcagagctttgcataataacaacgccattaggatttaaagcatctttcaatagttcgaaatacctctcttgaaaaaacgcttcagctggaccttcaggatcagaactatctgtaataatgacgtcaaatttcttatggacgtcggaagcacctatatcttgtaagaacttgaagccatcgcaaagtttcaagtccaacctttcgtcatcgaaagcaccattactcaatgtgggcaagaacttacgggataattcgatcactgatgagtcaatttctaccatagtgatatcttctacacagctgtgcttggctacttcccttaagacacctccgtccccaccgccaatgataagtacacgcttgggattagaatgcgcaaacatggcaatgtgggtgatcatctcttgataggcaaactcatcaaattccgtacattggacaataccatcgaggaccaaaacagtaccgtataccttgttacggaagattaagatgtcctgaaattcactgcgggcttcataaagtattgagtccacggtcatagtaaaggcctggcccggaaaacttttatcattaatctctctaaaccatccatctttgatgtaagaatgctgtgaattattaaccataatgtataactgaatctgtcactttatcctgcctgtctcatcggcgttttgatattttatttttaactaaaatcagcagcaacttgaaaaattttgagataaccttaaaaaggatctagcaataaagagaagctcgaagtagccatggacactgaagagaaaaaaaagactacagcgtcagtagagcatgcccggatgttgcaaaatgaaatacaacagttatttgctcagttgcgggatacgaattctcaaattcgctgcgatcttaacgagtttgaacaaataaaggaatcatctacaacagcggattcaaccacgaacagtgcgaactgataaatttatattcaaatatattttacataaacaatattaatatatatatatattccccctacaatgatgaatgcgtttctgccgtcacgtttcctattatcaccttctcttaggtcctcttattggtggcataggtcttgatgagttttttttgaataatggtgcattctttaagagatctggaacaacgataaatttgatctgtgacccacgtacgaatatttgatccatgtgtgttacagccccctggggctctgtagctattacatctcttagctgtacgttcatgctatcttcgctttcaacaagtttaccacgataagtcgctcccgttgttagctccagagaaacgatatgtccctgtgcctcatttaataatttcactggtattccattcatagtcattgtttctgatacgtgcctcgcagcgctttctgattctcttcgtattgctcttataagaattttttaacgatttcaaaaatatcaaatctatagaacgaaagaaataagaagctgccatccctagaaaagtaaaaactataaggtaccaagaagtaaaaagagaaatatagggatataatgataaaaacacgtatagaggaagttcagttacaattcctcacagggaataccgaacttacgcatttgaaagtctccaatgatcaacttatagtaacgacacaacggacaatttacagaataaatttacaagatccggccatcgtcaatcactttgactgtccattaagcaaggaactagaaactataatgaatgttcatgtttcaccaatgggtagtgtcattcttattcgaaccaactttggccggtatatgttgctaaaggatggcgaattcactcaattgaacaaaataaaaaatctcgacctcagctcgctacattggatcaacgaaaccacctttctgatgggaatcaagaagacgcccaagttgtaccgagttgaattgacaggaaaggatataaccacgaagctatggtatgaaaacaagaaactctctggtggaattgatggcattgcgtattgggagggctctctgctattaactataaaagacaacattttatactggagagacgtgacaaatatgaaatttcctttagtattaccagatgaatctgagcaatttgaaaggttaaaacatcatgcgataaagaaattcgattcgtacaatggactctttgcttgggtcacatccaatggaattgtctttggtgatttaaaagaaaagcaaatggaaaaagatcctgcttctaataattttggaaaattcctatcttcgtcgaaggttctactcaatttcgaactgcctgactaccagaatgataaagatcacctcatcaaggatatagttttgactgctttccacatcctgcttttgagaaaaaatacggtaacaatggtgagtcaattaaataacgacgtagtgtttcatgaaactataccgagacaccagttgactggctccaacactgatagtaatgagaaatttttaggcctagtaagagattcggtgaaagaaacgttttggtgtttctcaaacatcaacgtctttgaaattattatcgaaaatgagcctaattcggtatggaatttattagttcgggataacaaatttgacaaggccctatcgttgaaaggcttgacggtgagggaaatagaatctgtaaaactttcaaaggcaatgtaccttttccacactgctaaagattttcattccgcggctcaaactttgggaagcatgaaggacttgtcacactttggggaaatcgcattgaattttctccaaataaaagattacaacgatttgaacgtaatattgataaaacagttggataacgttccctggaaatcaactcaagtcgtcttgtcgagttggattatttggaattttatgaaacaattgaatgatattgaattaaagataaacacaactaagccagcttctactgatgaagacaatttgctaaactggaacctgaatctcaaggagaaatcgaatgaactaacgaaatttttggaaagccatctagaaaaacttgataatgaaaccgtttatcaaataatgtccaaacaaaaccggcaaaacgaattattgatttttgctagtctaatcaacgatatgaagtttttattatcattttggattgaccaaggaaattggtatgagtccttgaaaattctgcttacaataaataaccatgacctagtctataagtactctttgattctcttattgaattcaccagaggctactgtgtcaacgtggatgaaaatcaaagacttggatccaaataagttaattccaacaattttaaaatttttcacaaattggcaaaataattctaaactgattactaacatatcagaatatcctgaaaattactcactgacatatttgaaatggtgcgttagagaagtcccaaaaatgtgtaatccaatagtgtacaattctatcctttacatgatgattactgatccgagaaacgatatgatactagaaaatgatataatcaaattcatgaaatcaaacgaaaacaaatatgatcttaatttccagttacggttgtctttaaaattcaagaaaactaagacctcgattttccttttaacacgtttaaacttattcgaggatgccattgacttggcattgaaaaataacttgattgatgattgtaaggtaattgtgaatgacgagattcttatagaggattataaattaaggaaaagattatggctgaaaattgcaaaacacttattactttcaatgaaagacatagatataaagcaattaattcgaacgattttaaatgattccaacgaaattttaacgattaaggatcttttgccattttttaatgagtatactacaattgctaacttgaaagaagaactgatcaagtttttagagaatcacaacatgaaaatgaatgagatttcagaagacataataaactccaagaatttgaaggtggaaataaacacagaaatttctaaatttaatgagatttacaggatactagagccaggtaagtcttgtgatgaatgtggtaaatttctacagatcaaaaagttcattgttttcccctgtggccactgttttcactggaactgtataatcagggtaatactgaactcaaatgattataacttgaggcagaagacggaaaacttcttaaaggccaaaagtaagcataatttgaatgatttagaaaatatcattgtagagaaatgtggattgtgcagtgatatcaacatcaataaaattgatcagccaatatctattgatgaaacagaattagccaaatggaatgaatagtagtattcttttttagtcaggctgaaacactgaaattaaaagagggaagataaatatcattactattatctgactaaaatatgtgtcgagtatttacttacctaaatagccaagaagtaaaaaaaatgcgtatcaaaaatgaataaaacgtaaaattatcggggaaaaaccttgtattttcaaagagtaataaaacgggtgaattaaaatcacaatatatgtatggctgaagttcaacataagtcataactagagaaacttcttcttgcccatgagttaatattccacctcataattccgtaatctgtaccaataatcaaggagctcccattcctatcttcaacccaatcgatacctgatatattgttttcttctgagaattcgttactttcctgagttgtaatcactggtcttctcaaaaaattggatgtgcctctattattcctactatttgcagcaaaattgtcatcatctgacggtaagtctggcgttgaaggtggtctgagaaaactttcaaaagctcttgcggaaacaccatgatagtctgaagaaacacgatacgttgagtgaacatcattgtaagcttcataatattcatcatcttcaaaaacatcattactagcttgctggtgagaaagtattaaggggtcaattaaattttgaggtgcggaatttgacgacgaagttgcgatagaatcagcagcaggtgtgccaagacttgcgttaacattgttattagaataatcggcggttggtgccgaagtcgatactctccttaccctgaatgaacatcgtctcttgtatggatgagctacgtcacttgatgaactacctttcgtagaaaacagaaccgattcgttactaattttatccataactttcggaaaaggtagaatttgcggctccaaatacttttttgggattctttgagccatagttatccatggttctgtggttacatttggcatagagggcagcgaaaatcttcttcttgataaagaccgataatccgccccttgtaattcatttttgctatcattactttcgttttcgttgttattatttgtggtgaaattatgatttgtattatgcttccgttcgtttatatattccatattaactttatcaggaataacaataacttggtggttaacgtagtttcttgtatctacaacgtgtactctgccctgatgttcagaaatgaataataaatcatctaggccataactgaacctacagactctaaatgcaccgttgtgggaatgtggtctagtcgaactaatttctgccatgggagtagccatgtttctgatatcataaattgcgcaagtaccattttgaaataccgtcgcaaattgcaagtcgttttcggaaaaagagttataaaacccatggtctgaatttggagcttcatatatgttttcgatatattctgattcatcaggtaacgcaaaccgtggtatccgtctaacacgattgacagaactaccccaggaaggatgattatcgtaatgtaaggagaattggttggttaattcattttgattgtaaacagcaaatttattagaatcgccagacactaccatcgtttgaccatcatgtgacaaagaagcgttattcaaaggaaattttaaatccgcataacgcttcactagtgttacatctctattacttacatcgcattggtaaagatgaccatcattgttgcatgcaaaaagatcaaactgcatactggccctgtcataaagtgtgacacaattattgatgaactggcccaacgtaaaagtcatcattgtgtccgtttcttgattataaaactccacgatgcccttccagatattaggatttgaataatgtgaatttatagggaaactaatatttttggaaatattaatcggttgggaaggtggcggcaacgaaatatttgcatcttgagctaaacggttccaattagaagggaatcccttatcatcagaaccgattagaccaccacaaacagtcaacccatttaattccgtgaaacatctcggcttaaagttgaactctaccagtttctcggaaggaacatgtaaatttttggagatatacgagcccgttgtcctagaaccttttgtagacgttttttcagtagagtttttaccactgttactcggttgaatagaattatgtcgccttactggagacctcaatacggaagaatccgtatctagtactcttatcgaatgatcgtaaatataatacagtttactctggttcatggagcctggtttgatacaatcccgcaactgccaatggtttatggagaccttggcatcgtagagttctaaagcaggcatcatatagttttggtaaaccttatcagagccagtatttaaccgttcatcttgcagcgcctccttagattgccccgtgccatcaatggtcattctttaacacgtatacttttgtaacttattgctgtttttctaccactttattcgatcttacttgtcgttgcttaatcagcaaaagttttgtactagaataaagttgtaataggcttttaatccagagtctcctcctcctcactttctgatcatcaccccttattgcctcagaaaagagatcatactccgctttaaagccgttcaatgtcacgtgacacaaagttgtagccgtataacatatggcgctaccatgttgttatttagacgggtaacatcaccgtttagaaagataaaggaaagtgaaattattggaatggaaagtgttcccaaaagttcgcaccaacgcaaaaagaaatttttttttcaattttgatatcatcgttgcgtagaggaagccctaactgagtagagaaattatatggtattttccttgtaatatttgattttgagtcgatatcccctttgttcttcttccttccttcgcttgttttagttgtatacttggtttattgtggaagatttttttttctgcttcgtagttttaaattagaagttatttctttgcaaatttctcttccccccacagtattcttttagaggtgaagtagaaataaaccaagaaagcatacacattttattctcaatgtccaacccatttgatttgttaggtaacgacgtcgaagacgctgacgttgtcgttttgccaccaaaggaaatcgtcaagagcaacacttcctccaagaaggctgacgtcccacctccatccgctgacccatccaaggctagaaagaacagaccaagaccttctggtaacgagggtgctatcagagacaagaccgctggtagaagaaacaacagatcaaaggatgtcactgactctgccaccaccaagaagtccaacaccagaagggccactgaccgccactctagaactggtaagactgacaccaagaagaaggttaaccaaggttggggtgatgacaagaaggaattgagtgctgaaaaggaagctcaagccgatgctgctgctgaaattgctgaagacgctgcagaagctgaagacgctggtaagccaaagaccgctcaattgtctttgcaagactacttgaaccaacaagctaacaaccagttcaacaaggtcccagaagctaagaaggttgaattagacgctgaaagaattgaaactgctgaaaaggaagcttacgttccagcaaccaaggtcaagaacgtcaaatctaagcaattgaagaccaaggagtacttggaatttgatgccacttttgttgaatctaacactagaaagaacttcggtgacagaaacaacaacagcagaaacaacttcaacaaccgtcgtggtggtagaggcgctagaaagggtaacaacactgctaacgctactaactctgctaacaccgttcaaaagaaccgtaacattgacgtttctaacttgccatctttggcttaagccttatatatgaataattccaactgaaagaatccaataacagtgttctactttctgtttctattactattattattttaattggttatttactatataatttgcaagtgaagatgatcatgctggcaaaccaaagaataaaattgggttgacatccaatcgagaatatgacatatcattttgttttatttaagcaataaaaaataaatgacttttaatttacttttcaattttcttttttttttttctacttctgagatgtgcaagcgtgtagtttgtttgtatttgtataacaatttcatcattagtcattcttcattaaaaactttttgttatcgattaaggacatccagtatgattctttttctctcatcttgattatctcttgagagtattgttaggcaacgcattataccacagttttttttaccaaagcgagcggcactccagcaggtgcttcatgtagtattcaggtatcacatcgctatattttaagtttctgtcgccgttgatcattcctatctcccattcacttcttccgttcggttgcatctgattaccatagtcatgtagtccaactatcaaatcttcgtgccctagttctccttttaacttttcgtccattagtccattagctatacatgaaacgtcgaataatattttacatgtgagtccccacaaatccctgaatctgaaaatacctccatcaacaccgtcttcgtctgaacttgataaatcctctatggtttgcaaccatggcatttcgttattatttgctacgtgaaaatgataatgcataatcaaccattttattccaccccaattaagcttatactccttccgctcaaaatattctgcttgataactcttaacatcctcatcggcttcaggaagaagatgtataactaagtcattgagtggtacagaaaacaaagaagatgtttctccagggttcagcttaccaaaaaacttacggatatctaagggaactttgtatttatcctcatgtttttctaatttatctttgtaaagaaaacagaccattggcttaacacttaaaaatgttcttgataaatagcatggcatatccatgaccaaattgtctaatttcattccgaactccttatgcaagacctcaggatcatgcggtaacccaatctcctcttcagcttctcttctggctacgctttcaaaggtttcttgaaaataatcagctttacctccaggaaatgaaacatcacctgagaagcttctcaatgttcttgaacgtttagttaaaagcactcgtagttcgcctttcattccaatgaataatagtattattaccgccgaatttcttttgaaaggccatattgagctccgagtatatggtgttttatgaaatttgtatcttatcaagttctctattagttgctttgaactcagcatcctcctctgacttaatatcattacagcttttctgttacatgtgtgattctcttcaaatctacaatattattattgaattgttataaatatacttacgcggatccccccccacaaccctaccccaaaaaataaatacaacgaataaatacgcgattggaattcatcgctacttttgaaaaaacagaatatataagttgataataagctactcttgtatatacctattcgcctagggatataatcaaacttttaaatcgacctttaaggtatatgtaacaacaaacgccacagtgatgaaaagaatcgcatactgcatgacaaataagacggacaaacagttcatttgaatgtgatcaccacatgctggcgtataaaatgctgtgaaatatacttgagcagtagcactcggcatggaccacgttaatatcatgtcaaattttcctatgcccgtatccagccaatcgatcgaatatagtttatttacccataggacgccaataataggaatgacaattaatcgaaagcatgtcatcaataaggcggatttaataaatccaggtggcaatgacttaatttctaatcttgccaacgttccgccaagtaatagaagccccaatggaacacatgcatttccaatatactctgtaaaatccattaaaaaattcagaacaggttctccatcaggcgccttatgaacgtgaacatatgtcgttacgaagcatgctttaacccagggaattaatgcacatattattcctagtattgcccccagagatgctggcctgaggcaatttataataaagtactgcaaccatttgagattgtgtctctctataaagaaggagaggctacccctcccgtcggtggccatattagtgcaattttcttcttcgatggaactttcatcggtataaccagtgtgcacattaccaatacttgcgttcctgcttccaacttcttcagtcaaggatagtggtcttgataaatctaattcaccttgccttattttttcggcggcactgtatttggaaatcaactcattcatatccgctttcctttttcttctataacttctgccatcgctattttttgatatacgactatatgagagggaactgccatctattcgcgagaactccaatgcgcctgggcttgaataagtcgaggaaaccctatatatttcagcatgcggaaggtcactttcaaatttatgggatgcaccatttgattctttatagggtttgatgtagccagtaaaaccttcgtagaatgcctgcggtgtcatttcatttgtagtaatagagttacaagacaaatcgctattacttctcgcatcttccgattgataggcatttgtaggacgtgtgatattaggtaactttgttatttcagtaagtttgcgatcgtcgatagcgggacttactgacggagtaatattctcactatctggttcttttgtatctctaaaatcaagtccgaccactctccacattccaaaattcatcattaggaaactttgaataaataaaaaaatgcaggaataagcaacacctttatcagcttcttcagcagtaaaaatggagccgttacccatgctctgaatataggcaataggtaaatctgatatatttggaaagaaacccgcaaatatgagcccccagaagaattttttgggcacagtcgtagcaaatgtagtaaataaggcgcccgtggcacctaaaacaaacaagataaaagctgaaagtattatcactccaatctcctttatatccctccatgaaatattggacacaattttgttgaaggtcaaacaaggcaaaatagcgttaacaaccatatttgatatacctttcgcattttccatggaaacaatatcgaacttagctaccaaatagccaacaagcataatggtgtaaattttaaatataggttttaatgcaatgtaaatagcggcacccagagaaagggacatcttggttcatttattgtagtactagaaaatcgtttccaccatataaaaatgatagaccttgatcagacacatgtagaattaccgatagaagaaatactatatgagtactgtaacttgttttacctcttatacgttacacactttgatgtaaatatgactcaccttatgtaccagacattgacccaaaaatacagatatacaaaaggtgaaaaaagatatagtagttcctcgacgtatgcctacggggaaaacaatatagatggaattctataacaccgacagtgatgtttctcctgaaatttgtgccaaatagcgccgcggaaagtcggcacattttgcaacatggacttcggaggtctgatatcatcccgtaaccttctcgtaatgcatcagattctggtcatgcttgttcaatatacatcctacgtgcacaacgaacaatagctttctcggtatcttattcgattatccccgaagtttcttgaaacggcaatatccttttaccctatcccgggcgaagaaccccgtcacagtgcattactttattcccactatagggataacaggggcgattgtgtacgaataactagattgtatttagataactaagatatatgataagtgcgtaaaaatggatatatctatacatatatatcactaagtgcataaagtctttgtattttcgctttcctagctgaccagtaaaagatcttgttttttaactgatggataaatagtaatttataactgaatagagcaaaagttgggaaaatagaaaatagaaaacagaaaaggagcgaaattttatctcattacgaaatttttctcatttaagttatttctttttttgagagaaaaattggttctctacagcagaaatgatggcaggtacaacttctgggttggccaaagtagttaggtcacctagctgttcggcttcgttagaagcaacctttcttagaactcttctcataatctttcctgaccttgttcttggtagatctctaactagaataatggtttttggtgaggcgaaaggaccaatctcacccctaacttgtaagatcaattctctacgtaaattatctggtgtgatgtgttctgcatcaccttcagtagcgttgttttgtagataaccatcttttagggaaacatatgcaacgacggtttgaccggtcaattcatctggaataccgacaacagcagcttccgagacgttttcgtgatttgagatagatgcttcaatttctgatgtggataatctatgaccggaaacatttacaacgtcgtcaactctacccctgatccagtagtaaccatcatgatctctaccagcaccatcacctgtgaaatagtgaccaggataaggtttcaagtaagtatccatgtaacggtcgtggtggttccaaacagatctagccattgatggccatggtgatttaacggcaaggacaccttcgacatcattaccttctaattccacacctgtaacagggtcaatgatacaagcgttaataccaaagaatggcacggtagcagaaccaggttttgttgggacagcacctgccaaaggagcaattaaatgagaaccagactctgtttgccacatagtgtcacaaatgacacagtttttgttacccactttttcatgataccattcccataagtctggagagattggttcaccgacggaacccaagacacgtaatgaggaagtgtcatatttggcaatttcggcttcacctacacgtttgattaatcttaaagcagttggagccacatagaaatgggtagccttgtgacgttggataattctccaatatctaccataatctgggtaggcaggagtggattcgaaaattattgaggcggtacccaaggttaatggaccatatagagcataggtgtgacccgtgatccagccgacgtcaccggcagtgaagagaacatcttctgggtgaatatcaaaaacgtatctagttgttaaagcggcacctaataaataaccacctgtagtgtgaacgacaccctttggagaaccagtggaaccggaagtgtataataaaaatagaggatcttcagcgtcacatgaaacaggaggtaggtaagttctctgcttagcggcctcctcatgccaccagtaatctctaccggccttcattggaataccttcagtaccagttctttggaaaaccaagatacgggaaaccaaatcgactccgttcaaaccttcgtcaacaatttttttagtgttgatggtcttaccacctcttttaccttcatcacaagtgatgaccactttagaattagcgtcaacgacacgatctttcaacgaaccagcggagaacccagcaaagacaacagagtgaatagcaccaatacgagccacagccaacatagcaatgaccgcttctggaatcattggcaaatagatagccactgtgtcacctttcttaacgccccagctttttaagacaccagcgatttgggaaacttttctgagtaattcaccaaatgtgatgattttgttgtcggattcgtcatcagcttcatagatcaaagctggcttgtcgggattagcaaaggcatgtctgtcaacacaattgtatgatgcattcaatttaccgttcaaaaaccatgcaacatcaccattgttcaatgaaccagattgaactttggtgtatggagcatcccaatgcaagtattccttagccatcttatcaaagaatttttctggctcattgatagattgttgatacatttcttgataatgttgcatatcagtaacgtaacccttgccgggttggctgttgtaaaaatgttgaggagccttaagagcctttacgttgtgagcttcataaactactttatgttccttgattgtcatattttattattgtattgatttactttcctgtattctgtttgtgtataacaatcactaaccgcggagacacacaattcggaattcgaatactatatatatatatattttaaggtagaggtatatataaggtttgatcaggctaaacgtgcggtgcgatatcgttgctaaaattcagaacactgttttcaatctcgaagtaaaaaacgataaaaattatcaacaaaaccagtgacgaagaagttcagtcacgaaacttttttgcctcgttcaaaaaaaaaaagccagcggaatcggctaccgaatatcggcaataacgcttcggccccgggaaacgcatatgaataattttaagttagttttatgctatacagcgggtggctacgtgtaatgtatttaatgtttatatttactgatttatgacatcgatgagggagatcaattcttgcaatcgcgccaattcgttgcgatcagtgccctctctttcgtaattattcactgaaactatcttgccagttattgtgtttcccgagaggatggcgccattactgaaggtattactagttgtgttatcgctactggaaggcgtcgcagacttttccctcttcagttccttgccacgaaagtaaatagtatcttcgaatttgtaatccttaaactcttcggttggtccttgatactcggtatagaaaggcatgaagctcacggtgtaagcatctagattcacggcatctttggtcattgcgtatttgacctacttactgtattagtacacacttgtattttcgggccttgatggttttgtttcactgcttgtttgcaattggttgttgttcctaacgcgttttgtcatttttcgatgaaggtcgaacggaaagaactaaaaaagactaggggaatggaatgcggaatagcagtgcatatttcaggatgaatggaaaaacacatctgcagcaacaatgaaaaaccttagtggatttaaacttctcacaggaaatatcgatcaaagcaatgggctagccaaataaaaaaaaaactgtaggcacaaaaagcagcatacgtcattcgcaaaaaagaaggtcctacccggattcgaaccggggttgtccggatcaaaaccgaaagtgataaccactacactataggaccggaacttcttgatgatacgaacgattaaaattgttgacgttctcttctttttttcatatttgagtagatctgatgcgcaatgtctatacaacctggcagacaattgtctaaataatattttgtaggaataagagtccactatcgtctatcaactagtagtcacactaccaatatattatcatatacggtgttaagatgatggcataaggtatgagaaactgtcatcgaagctgaaatgcaaggattgatagtgtaataggataatgaaacatataaaacgaaaagagaaataatcataacattatttcctagagtagcgattccccttcgcgtattcttacatcttcgaagagaacttctggtgtaagtataataaatattatagctctatcgaatggtgcaattatttaccaaattctcaataggaatccataatactacatacgatactaatattctagtatttttatacttattatttcttttttattacaccagcaatcgttgcaaattatcttctgatagaatttctgagggtatcctaaacttatgccattttcttggactgtaaatcatacttggatgttgtgcattagtcaataatcggttcttgttccaacgattacatgtaaatgaagggagaaataattatggtaaatcatgcggcggtccttttggtgatgcagtatccatagtcactacataacaatcttagtcaccttgtattgattcaccacataatcctgcagagcccgctatgtccttaatctgcgcgataactctcctacccctgaattttgagagcgccatagcaaaccgataaagctggcacaattaaaggtatcggtgttgtcagaattaggtgcctcctgcttttttttttttcctgctcttatatccgttatatccgaatgatttttatcgcttgtttaaaaaatactttcccgatatatatatatagtctccctttaaatttgtttccggtaagtttttaacaccaataaatgaaaagaaatgactacggtgatgaatatgagccgcgcattgaatcaggttatgtaagtatcagaacccctaattatgatgtcactcttacccttcgatggctaagcggcgactgggatgccgggaaaagctctacaaatctactaaaaaagtcaaatatacagctgtaaacttctttcctcgtctacatcatggtaacgattgttcaatctttacttcgtgtcttttttttttctatgtactttctattccaacctatgtgaagactaaaattcaccttagtaaacgtaaagacaatgacgataggtgcctaaatccaatgaaaagagcacaaacagtttccatataattaggagcagtctacaatcaagcagtaaattttggtatcataaacgacccgctgagacctttccattgggtcaggtcgagaactgtagttactcgaaaatcagatcatccacacgctgttgaactcgaaaacagtagcactgtcactgtaagctagtgttcattttaaacgtcttgccgaattttttcttcgaagaaaagtattgcaatggactctatacttctgagcagcaattaaggaaaacagggtaggtaacctctggggttgatatctggataaactggaaccatattagcgagatgatgcactttacatagattccgcgagtaccttaatactgctggtgcaccacgataatgattacttcttcaatatcaattagtttgccaggatataccttatccaatttagcgtgacgatcttaaaggcgtttttatgtttattcgctaaaacccttcttattgtcattttcgttaacatactatctaacgtatttctgtttgtcagtaattttcagttaatggatggtatcagacgaaaattaaataaatcaccttctgctttataagcaagatataaaaaaaaatatggatcgattgattcatttccataatgatcaatatataataataataggactgctagctaatatatactcaatatgatttgttcatattcttcgcaggtatatataaccatcaagtaatacatatttaacttagctgcatcaccgttgagccttttgttgaacacttcccctctctatcataaaatcaaccatatagaaacgcatagagtgtaaacattgatatgcgatgccaaaacacttgatttgttactatggaacacacagcaatatgcatacactacttgttccattgctgttgcaattccattggatagaactcctgcattgtcctcatttagtgctcaggaaaaggtttacatatttctttctgacttttcagaaaaaaaatttgtgaggctgtcactgtatatcacgtaatacacatataagtaattggatttatagtaaaaagaattctcatgttgggcacaactatctcgttgccaaattttttaccatattaaaacgacccatgtaatataattggaaaaattagtatactgggaacaatcttgcggcacaccgcttgaacgaaacgttcgtaaaaatatttataattcttattattattatttattattattataatatatataatttaataatcttaatatttattatcattgtttcatatttttttttataaatatttatttaaataaaaaatattaaagagtattcaaaaaagtcttactgtgggtaatggatatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggttttgttctcttccctccatttccctctcttctacggttaatactttcctcttcgtctttttctacaccctcgtttagttgcttcttattccttcccgctttcctgcactaacattttgccgcattacactatatgatcgtagtacatcttacaactccgcataccgcgtcgccgcgtcgccgcgtcgccaaaaatttacttcgccaaccattccatatctgttaagtatacatgtatatattgcactggctattcatcttgcacttttcctctttcttcttcccagtagcctcatccttttacgctgcctctctggaacttgccatcatcattccctagaaactgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgcgcaagcacgttacccggaccccgtcttagcacacgcacacgcacacgcagcgctcacagaccagcgaaacagacctgagagccacgatgcagcacacgcttacccggaccgcctctctgccagaacgctcgagcagcgcccacagcgccgctactgcgttacccgcacttcgccgcccgccagacagctgcgagactctcgtcccgctactgtgtatcttttggttcgtcttcgttagtatgagcccgctcccgccggctcgtgccaacaaatcagacaacaaaggcttaatctcagcagatcgtaacaacaaggctactctactgcttacaataccccgttgtacatccaagtcgtatacaaatgatttatccccactcaaaatgacattgctatccgccggcaagcacccaaggcctttccgccaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctggcgaaatttattgtttttacataaactgtattatgaacagaaggtagtagtgcattagaggtattacatatcacgtgatgtttatttctttttacctatatatggattgaatattagagttaccctacgttcaatttctagattctatggtgttacccctgatgagttctgcatctgtcctatctacctattttaccgttttggacgaatattaaagggcgggtaacacaaatactgtctgcgtaatcaatctttttaggactaattaagggtagttccatagttattagaatcgtatttctcgaattgaatttccttccctatgataaacttctacactggaaggtcatcattattttttgttaagtactttacgaatgagaaggtagtttatcagcttatatttcaggtccgttgactttttctggctacagttgttttcaactggtgctgctgcaggatataggaagtcgaagatttatttttttgcacagcttaatgttcctggcgaaaaagcagcgaaatcgagaggtatttactgctcagagatatgaagaggtaggtacatattcattggcagatattctacaatgcaattattatgaccaatcacacagtattgtgctgacctccattgagcgatgactaaaaaaacttttagtagcacgtttattattgctttcccttgctgctataagggaaaattcagtaaataataccgaagatataatggtgtttatcagatcagtgtgatgtgttcagctaaatggaaagctacagatgctatctgatcgagatattgcaagaaaaggtctcacagtatttttttcacgtgcttttttttcaaggcaatgaccaatatgaaacgatcgatgagcatagtaaacagtattatctggataattctgtatgcaatggtaacggataacttaaaatctttatgttaagtatatacaattgcatcactttttttttttggcttgtggcttatattaacaaatttattgtgcattttttgcaatctgaagggctgctttaatattgaatacgggaagggccctttcacaccccactataagtgcagttttaggaagaaagtattaatgtatccttcaaaaaagaaaatacacgtgctgttaatataccgacatcgtgttttggggaatgggtactagagccgccgatatctattcatattttttatgtagcaacatctcatttgaacaagaatttattgacatagaactttatacaagtatgaagagaaattagaaattagcagagatgtgaaatgaacttactaataaatcggcgtggtcattggttcagtttttcttcgatataggatacattagggacagtggatgtatttcctagggcaaccattgaaactggtttgttttgtaatctgtaatttgcccacataataatatcatccttagtgattttatcaacctgctcgaaaacttcttctggtgataatcttttacctgtggtcaccacttgtctgcctatatcttctacaatggctgtcgatccatccaacgatagcaacagagctgcctttagctgagcttttgccctattcacctctgcatccgatattttgccagattttattctcttccactctttcaggatctcattaacaattaactgcacgttatgctcattagaatcagttactatgtacattccccacagacctgaatcagcgtaagaggtggaaaatgacatataagaattagccaaagaaccattttgacttgctgcaacagctaatggagagggggagtttgtacctgtgccaatggctctgtcccagttaccaacaatcgcttgtgttgccagagctacaaaataatcaggtgcagaccatgacacgccttctaatgcgatagcaatatgtgttgtaggtaacgtgttttctttgataaacctttcacctctacaaaaaactggtaatgggccccttggtgatcccaacgggacaggcgattcagatttgggcacatggccaaagtatttttgagcatactgtaccaatttttcatgatcaacagcgcccgcacctgccaataccattctgtcgcctttatagttcttggttatatagtctttcaaatcagttcttgttattgattttatgttttttataggacccagaatggttcttcctaaaggttggtccttatacgttatctcatgaagatggtcaaaaacaacttcatcatacatcttgtccacctcttcactttctctgatgatgacatccctttctctctcaatagcactattatctaaaactgacttagtcaaaatatcacttagaatatcaacagcctttgggatatcttcttgtagggacttagcataataaactgtgttttctcttgatgtatatgcattcaaatgagatccgatattttcaatttccaattcaattccttgttgtgacctattctgagtacccttgaaagccaagtgttctagaaaatgcgctgtaccattgttttttacgttttctgccctagaaccagcatcgacaaatattccaacagtagccgaagatgtgttggggatgtactctgtggcaattgtcaacccattaggaagtttagaggttctggttcctggaatttgtgaggaaattgtacttaaaagcctccgtgtattacggaacttggatgctgttcttgaaaacattgtatgatcacctatcactttgcgcactagtttgatgcctgagagcaagatatcatgatttatccatagcgttcaaattcacttcttattactaaagagatgagtccagctcgattacgaatatcactaaatacgtgaaaataatattggtcatctaatctgtgcactgaacagtagtatcacccattgttggctgagaaattaagctcagcattttagctttcctcactacgtgttgaggaatttaatacgtaaatatagtcttagtaaagccgtgcattttacttcttaactcctttggacgggatcaagtttaaggagaatgaaaccctgattcgcaccttcaacgcggctctaacatggtactatcagactctcacatccagattggagtacccttatccgaagtaacgattttttattacgatttaagataatgagggacgcgtatgataactaaaaatcgtcagttgaagggcgctggccataggtatcccttaattttgacgtcgaatttcacagaagcaaacctatatattttcagtccccagtggacagaccgtttatcagttctaatgaatcagcaaagattctcaaaaaggttgccccaattcttaggaaagtaggaatgtcatcgactaagtttttgaaaccactctgcaggataagggcttttcatacttcaattgccagatcctttaccattccttttctgccaaagattccacagaaacctggaggtgtgagtgggaccgcaaatgattcctcttatatgccgcccgaaagcagagctcagggttcgtaccattggattgtcgagcgcggactgtccttagcggttcttccgctgatcgcagttcccttggtcactacaggccctatttccacttttaccgacacatttctttccttggtcctgctaggtcattgtcatatcggatttcagtcttgcattatagactatatttctgaaagagtctatggaaaggtacatcattacgcgatgtatttattgagcttgggctcctttttatcgttcgtcggtatatataaattagagagccaagaagctggtcttattgcctctttaaaatcattatgggataacaaacctgtggaaaaaaaagaggcagtaatcatcaattaatcaatatggtttggttagtggtgactaccttttttattctcgttatatatgtgtattagaaataatttaataaccgattatttattgcttgttttactggtcccagttttccaacaggacttcttttatgggcaaagtgaactcaccctcttcattgacgtattttcttgaccaaagttggccagtattattgtgttccataggtatcaagtgcgttttagtttgcaggccaattttcgttattatgcacgctgaatgcaacgctatttggtcattgaacaactctggaaaattgacagtgctgccatatttcttgtcgtttaatatgggctgatttaaaatttgagagacgtgatttcgaatctgatgtttttttcctgtaaccaattgtaaaacaatacaattttcgtcaacttctttgaacttagtaatctccctaccaccatgtgaaatcaagaaattatatttaggaccatatttaatttcatggttatttggtttgttgaaacgaccggacgactcgacaatagctacatactttctttgcaacttataaccgttgttgccgcccttttgtaaaaatctagagaattttacacttgcgtctttagtctttgcaatcagcatcccccccgtaacacaatggtctaacctatgtacagtacgacataattctacttctctatgtgaataataaatagccttgaatctttctagtagtggagtagggtcaagattaggatgtgtcctgccccatgttctgcagtctggtggttgagaaggtatgccaggtggtttattaactatgaagtaatgcgtgttttcaaagattattggtatctgctttttcagagacattaaaatatatcctaactgatcctgatcttatagccattcatacattgttcctttttctttttcctcttaagtaacttcgtgggcctcagaaaaaggtaatatgcaaatgataaaaatgcaacagttctcaaaaaaggcattctgccaaaaaacgtgaatactctatgtacgctatctaaaattcaatttaacgctattaatgaaattgtcatgattgaagtcctctctgttggaaatgtagctttgaataatatcccttccaatgtctgctaaatgaccctccttagttagtgattctaataattcaggttgaacagtaaatagatttgcaagttctctcaaagtagcaaatttgtcaatcaaggacgctactccccaatcttctattgcagtttggtagcctatgatatccttcgtaactacaacaccgccaatggaattgacttgaaagtgtgaataatgtgacagtagtaaaccgtataactcttccccaatcaacgttaaaaatgtctgtaagttttttcctttaagaaacttggaagactgttcgaagattaagtttaaaatattgacaatctcaatagccggtaaggtgtcttgatccaatagctcttgagattttggcacaaaatccatcttcttttgcttgcacaaaattgcggaaaatttagtcgaaattaccgtaatggtctcttgcaaaattatattaataagtatttccatcttttgaatttgtgaatttgtcatctcaataatctgagctttaatttctggcgaattatttaataatggtaagaaaatggatttgattgaaattgacaataaatctaatatctccgtgctcattgaaataaatttcaagaaatttaagtttaccactcctgctgttttattaatatcaactttacaaattttccagtaagcgacttctaacgcaatttccatgtacgaatcaacaatccccaaaaacattatttttaatatttctaggatgtatagatgtgctttgtttggaattagttccattactcttgcagtagactccaccacacattttaacatagaatcaacatcgttcaaagaatagttcgccggactgtttggactgttatcaatatcgcttgctgtaaaactagaatttaccaaacttgaagagttgtttgctacatcatactgtgtagaagaagagctgttgttaaacgaatcgctcaaagtatttgtacggtttagactcaaatgatctttatctaaatgagttttcaaaaaggaattaaattgtgacaatttactccttgatgttgaatcttgacgagagtgtgtattccctctaggagaatgcatgaatgcatccacattagttgatagtttctccttatacttatctaataaaaccctcttgttgatttctttatcatagtttacagtaaacttggatgtcatatctactagaatcgcttccaaggatcttttctcaataccgaaatatttggacctatcatatagataatgcgaaaacaaatcagcaaaacattgttctagggttgttgataagatttggttactgtcgtcaatttctagtagttgaaagtaatcaattaaacttttagtgaacttaccaaataaagtgaacagtccgtgtaatattctcacataagccaaatttgagattgacagggaattcctcaataaaacctcaaatcttggttcaattttttgagcaaaaactctctgaataaacaattgtatcacatgagttgccttttcttcaaatacccttttaacaatcttggattcattttttattacagtttccacatcatttatcaaattttgcatggatgtctcgatgataacactgtggttctcaaaatcaatcagctgttccttaaacttcacgttttttatgaaaacattctcaaattcattttccaagtcaatctgcttggtgtcaatgaaataatcgtgctgattgatgaagctttgaatgacattaacaccgccattaaaattgttgagaatgatggcaatttcatttaatttagtaaaattattctctctatatgcagaattaaaattctctaacagctcattttccatcatttcagagtacttttcaataaccagctttgtgtttattgtttttggtactgaacttgtctctagtttggatgataatatcaatagattcttcattaatttcacggactttaagtttaatttccagtttttagacagccttaattgttcaacaatatctgattttcccatggaataaaagtcattgtacctgcgaatcaattccacactttgaatatagttttgctttttcttgattgcggtttctaatttatctcccaatggcgaaacaacttgagtaacatttgtcaagcgatcatctagcttgtcgaatgtaagtaaagtagtatgcaaatccttggataattttatcacattctccgaatgaataacttcctgagtagccacttgctcggaaaaatactgtcttttatttagtgtttcctcatttaagttttttagttcctttaaggtagattcaaaagttctaatgtaaggtttcggatctaattgtttccaaatagcctctctgattgcatcctgatccttttcattggttggaagatttttcgtgtttgcatcaatcaacacgtcattacgatggtctttgctcaattcctgaacgaattcattgaccgttaatccgcccaggaaattgtccgttttcaatagtttcttccatttcggatcgagttcatataatgagttcatgttgtaacaccacttgatgacaaagcaaatttgctcaattttctatatccctttaatgcatgaacggttctttattttgttttctgtcgacattctagtttttcggaatctcaaaataattaattacatatacgtacataagtagcccagataaacaaaaataccttaaaaaagagttactagccgtatatggatgtttgaagatacatggaaaccgtctctggtgccgtgtatataagaaacttctagatttattcagacgcactcattatctttgctacataacatttctctctgatttgactgcgcatcttacccctcccccatgcatgtggagtcataggagtaattttaaaggtagaatttcatattaaatatcgctgcttgattattttgtagcaaatcaaaagagcgtttcaagtaagtaaaaacatttgagcctccccatttgttgaaaggagagaaattaaacttggttggggttaattatttgatgggtatattaatttgcaaccgcaaggtatcgataataaatattctacaaaacctttatcaatagtggtgaagtctttagtgcgatctacctggggttaatgaacgagaagttcttgagatatctttcctgtttacctccgtgcatcctgtaaggaattgggtttatcatttatcatttagtacaaacttttttttttggcctgggcgcactttttcaagcggtgggaactcatcaaaatgaaaaactagatacttttagacttattaaatggtttaaatattttgagatgttcgttatatcagaaacttccttacttctatcttttattccaatacaaagaagtcacaagattacttggtaagaaagaagcagttagtttttaattttgccgacaagccaagatgcaaattttcgtcaagactttaaccggtaagactattaccctggaagttgaatcttctgacactattgacaatgtcaagtccaagatccaagacaaggaaggtattccacctgaccaacaaagattgatctttgctggtaagcaattggaagatggtagaactttgtccgactacaacatccaaaaggaatctactctacacttggtcttgagattgagaggtggtggtaagaagagaaagaagaaggtctacaccaccccaaagaagatcaagcacaagcacaagaaggtcaagttggctgtcttgtcctactacaaggtcgatgctgaaggtaaggttaccaaattgagaagagaatgtagcaacccaacttgtggtgctggtgttttcttggctaaccacaaggacagattgtactgtggtaagtgtcattccgtctacaaggttaacgcttaagtaaagtatttttaaaacttatatattttaattgatcgttaaattttgaaaaaggcttttaatattgtcattatttacttttctatttacaacaaaagaacaaatgaatagatagacagtagaggaatataagtagtatgcagtgccatgcgggatcaaggaatttgtatctctaattttcgtggttgtatgcgtctctaaacaagtcaatattttgctgtaagatggttctgccgctcctttcagttcctttaagaagcgtacctgcggatattttaacatcctccatggtttcattgactttactgacaagttgattgctcaagtcatcaacatgtttttcccaattttcactaaatacttgcaaaacagcatcgaatcccattttaccctttttagcgttctcgcaaaacctttgaactgaccaatcttccatcttattacacagctttctaatggatccatatgctgtaatttgggcttcctgctggaaaagtgttttattagccgagtcatcgggatgcgggctatatgttacagtttcgtagacttttaatagattgcacatcgttaaattacagcttctcatggtcaagctctttttatttaagtctaccacagaaacttctctgacatgactcatattggtccctcctagcatcatcatgatccatttgggaacaccttgttttacagtaatcaaccgttcagtaactaagaccttaccttgatccttcaattctcttcttaaaacgtccactgcgatgacatgtgtagatatttcatttgggtattttttccagttagcggcggttacctggtcccatggatagttgaaatcgtaactgttttgaaacaatttcattatcttcttttaattattctcgattattttattttagtctgaaatctattctttcgtcctattgatgcttaaattcaaaaatatgtacatcactttgcatgataattttatcgcctatatattctttacatttttcacattcattgctttttaccgctctgaccaatcaacgttgtgccgatgctcgcaaaagatatttttgtccgggcaacggcttttgcgacagacggtaataatagtagggccccttgtccccttctcatcttattcttctcctttcttcttcattccattgttttttagtggccctaactcagtaccctttcaagattatcgttgctctccatggtgtccatcacggtcacatggtgcagtacttccttcctactgctctctgcgatggagccatcgcacataatcatctcattcaagatatcgtagaccttactgaagttaaatataatgtctaactcacaaacattgccgaaatatgtgtccattgtttcgacaaaccgatggataatttccaaggtcaacagttcattgtcaacatcgggcgtcaccccaacaataaaatatagactagcatatcgcttgtatactactttgtggtcatcatactcgatgatgttacacattttgggttttcttgctaatatcgtaggtgtcaagtctttcacaatttttgccttttcaccagcggacattgccgtgtaccatttctttaatctgatttttccttgcctagaaaccagcaacaaatattttaattgcgtcatcttgtgtacctgtgtatccgtatataatctcctccaggatcgctcttgtttttggctgaaattgttgttataacttcttgttcattcattgccatttttacacatatcgttagggcccgattcgtttgggatcgaattgttacccgactgaaaggatctattcaatatacattataaaaaagaaactacacatgagcgtgtgcattacctttactcgtcgctgtcgtcttctgtgggtgggacccatgccgcaggtttgaagtactcttggtcatttgccacatctttcccaaacttttctttgtcgtcggcaaactctagcaggtattccagctccaattcatgacattgtctgccgaggatgacaagcgaatgaagtggctcgcctgaatcgtaattggctaactcacttatggtaccagacttaaagctttgggagctcgagcctaatctactaattgcaactgctggagtatcgggagtgtatgcctttgtacctcttttctcttcaatttctaataattgttcacaacattgagcgatagacatgtatcttggtggttcgtagattaatctgccacgggccatattttcgatgctttgttccttaactttgatgtccaataacactaaagtatgaaggccaattttcctattttcccagatcttgtcgtaccatgagtccggtctccaattatcggtaaagaaaaccatggaaacggtttgaccgaaattgtatagttgtaggccacatgccccaactgcattcataacggacgcattatgaataatttcgacgggaattgcctcacgtttagctctgagaactaaatctgtgtgtgtggtggcaccaaatggatcgcccacgaccaagaaagcaacgtcttccttatcggcgttatttaggatctgcttagaaccagtctcaactaattccctatcagccaagatgatctctttaccatagtaagattctaactcttcttggcttgcagccattaggatactggtatagtgttctaaataaactctagaacatttcttaatagcttccaaaccacgaacggtaatgtctgatttgtacgagagaccaagtccgatcaaataaagcatttttctcactgtcctttattcactctatatcctgttcgtttttactttgctaacaaccaccagaaaaaaatttcatcccatcgcttagttaacttttttttagaatcgcatgcatgggattatttaattttctctaaaggtaaatgcgaagcccagaatcaaaaagataaactgtctaggggaagaagacgcaagatcctcctgtttttgggattttttattgcttagtgtagtgcattactccttgagccttttaagatgcacactaactcacccttacgagcggataaccaagatctagaaactcaaccactgttgagaccaaacactgaagaaagccaactcctcaatgatgaagtgagaatcaatgttgcaaatgagacccttattaaatctcgttggcggagtataaagtgcttaattatatatctgctaggtattattttattaagtttctttggcatcagcatagtgcagtatattaggggacatgtgccgcccacagatgtgatagaaaagaatctagttcaagtaacaaatttcaaactggtggagtttcagcttgatggttggaaagataatatgggctctgacctgaacaatgatacaggtaagtatttgcaggtgtctatacactctcaaatttggttcgattatgacaaatggccaggaacggaaaatgactcggacgccagaagccaacgtgactggatacggtacatcaatgaaaatgttcttaaaaccatttgtatagatctgaataacgtgaccacattcgatggagatctagtgtttaagaataaactgggagatgttgttggcatggaacccatttgttttaatttggctcaccgacagattaataacctacagttcaaaattttagttaaaccgtctatttggaaaatcgtaaaagttttgaagaaattttggaatagggattttgaatccttaaatataaaatcgaatttagatatgactatcttcaagagaaaatttggtacgaggtttaatttattgaaacttaatggcgaaatcttaaattggaaagatattattgattgggaaaaaatatcggtaacgccccttcggatgattcaaaatatgatcgatggaatatctcttcaaggatttacattacgggactccagttctgatggatttcatgccgatatgagactgaatccgatcacgattcttggaggggtggactggcttcaccttccgccaggcacgtcaatccctttcatcaattgggaaatcaagctaccggactgtaacggtgagcctgctgtcgcaattccaaccttgtcttgctttaacgaaccgattaatctgcaccacgacaacgataatatcgtcgtctgtttacaaaatgaaattgaaggtcctctgcccgatgaactactataccaagaatgtcctcaaaatagtcttacaccaatgagccaaatagtgaatgcggtcctgaaccagaacgagactgttacgttcgcagcaagaggccatgtccttgaagatggtatagataataactcattgattccggcagacatgctggaggatattttccaagaagcatcgtttattcccattactaccaatgctacgtttaactccagtgaattgattcaagagtttcagatcaacgatcttcagctacggtgggcagcgcgtaaaaagctcagtcttgtggggacatttttaggattctttgatctatccttctacgagacgcatcagcaagaccgagttcgcatcgataccattcggggacagatcgatctgtaccataacgacatcaatttcttaaacttacccatgaagcaatggatcaactcttcatcgcacattctgcacgatgaggacacaggaaatacgcagatgaagcttcaatttgatctagaaaatgacgacatggaagtcgtcaatagcttggaactaacacgaaccctgaacgaaatactattccagggttttacagttattcactttaatgcgacgatagatgcgtcacttacgacggcattgggcccgtgggttctcaccgggttagtcggagagggtgacactttggtcacgtgaacgtctatctatttatttttataactccgggatgtcattgccggtggtccgaaaatcggcaaataaggaaataagggaagaatatgcagtagtcaaatcatcagtgttctctttgatacctttcagggctaggaatagtgggggtggagtataatatcaaaaaccggacttaacattattggttcggttggaattggctataggcaaactagtctccggcatgatatataaatgacagcctgcaattgtatgttactacactcttgacttgtcgactacaatcgctgctcaggcacgagaataggaggtaagaaggtaacgtacgtatatatataaaatcgtaatgacaaagattaaggtagctaaccccattgtggaaatggacggcgatgagcaaacaagaataatctggcatttgatcagggacaagttagtcttgccctatcttgacgttgatttgaagtactacgatctttccgtggagtatcgtgaccagactaatgatcaagtaactgtggattctgccaccgcgactttaaagtatggagtagctgtcaaatgcgcgactattacacccgatgaggcaagggtcgaggaatttcatttgaaaaagatgtggaaatctccaaatggtactattagaaacattttgggtggtacagtgttcagagaacctattattatccctagaattccaaggctagttcctcaatgggagaagcccatcatcattgggagacacgcattcggcgatcagtacaaagctaccgatgtaatagtccctgaagaaggcgagttgaggcttgtttataaatccaagagcggaactcatgatgtagatctgaaggtatttgactacccagaacatggtggggttgccatgatgatgtacaacactacagattcgatcgaagggtttgcgaaggcctcctttgaattggccattgaaaggaagttaccattatattccactactaagaatactattttgaagaagtatgatggtaaattcaaagatgttttcgaagccatgtatgctagaagttataaagagaagtttgaatcccttggcatctggtacgagcaccgtttaattgatgatatggtggcccaaatgttgaaatctaaaggtggatacataattgccatgaaaaattacgacggtgacgtagaatcagatattgttgcacaaggatttggctccttggggttaatgacatctgtgttgattaccccggacggtaaaacctttgaaagcgaagccgcccacggtacagtaacaagacattttagacagcatcagcaaggaaaggagacgtcaacaaattccattgcatcaattttcacgtggactagaggtattattcaaaggggtaaacttgataatactccagatgtagttaagttcggccaaatattggaaagtgctacggtaaatacagtgcaagaagatggaatcatgactaaagatttggcgctcattctcggtaagtctgaaagatccgcttatgttactaccgaggagttcattgacgcggtggaatctagattgaaaaaagagttcgaggcagctgcattgtaaacttactcaatgacagattgatttatttatattatatattccctttttatcgaaaagcttttagtattttctactcgtaacatatgatcttctgttttcactgaaaaattttctttcttcttttccctcttcgcaaaaagaaaatgctgaaaaaatttgaaaaattttcaaatgatgagatgtttagcttaggaaaaatataatgtaaagatagttttcagaacattttttatttggttttttttttttaaagtattcattatcatctggagttcgttacaacctacacagaggaccgatatacacaatgtcaaaggaggatttcgttattaagcctgaagctgcaggtgcttccactgacactagtgaatggccattacttttgaagaattttgataagttattagtcagaagtggtcactatacccctatcccagctggtagttcaccactaaagagagacctgaaatcatatatcagctcaggtgtcattaatctagataaaccttccaacccatcatcgcacgaagttgtagcttggatcaaaagaatcttacgttgtgagaagactggtcactctggtacattggatccaaaagttacaggttgtttgattgtttgtattgacagagctaccaggttggttaagtctcaacaaggtgctggtaaggagtatgtgtgtattgtcagattgcatgatgctttgaaggatgaaaaggatttgggccgttcactagaaaacttgaccggtgcgcttttccaaagacctcctttaatctctgctgttaagagacaattacgtgttcgtactatctatgagtcaaacttgattgagttcgataacaagagaaacttaggtgttttctgggcttcctgtgaagctggtacttatatgcgtactttgtgtgttcatttaggtatgctattaggtgttggtggtcacatgcaagaattgcgtcgtgttagatccggtgctctgtctgaaaatgacaacatggtcactttacatgatgttatggatgcccaatgggtttacgacaatacaagagatgaatcttacttgagatccattattcaacctttagaaactctattggttggttacaagagaattgtagtgaaggattctgctgtcaatgcagtatgttatggtgcaaagttgatgatccctggtttattgcgttacgaagaaggtattgagttatatgacgaaattgtcttgataactaccaagggtgaagccattgctgttgctatcgcacaaatgtcaaccgttgacttagcttcctgtgatcatggtgttgttgctagtgtgaagagatgtatcatggaaagagatttatacccaagaagatggggtttgggtccagtcgcacaaaagaagaaacaaatgaaggcagacggcaaattggataaatacggccgtgttaacgaaaacaccccagaacaatggaaaaaagaatatgttccattagacaatgctgaacagtcaacttctagctctcaggaaactaaggaaactgaagaagagcctaagaaagctaaagaagattctttaatcaaagaagtcgaaactgagaaggaagaagtgaaagaggatgacagcaaaaaggaaaagaaagagaagaaggacaagaaggacaagaaggaaaagaaggaaaagaaagacaagaaggacaagaaggaaaagaaagagaaaaaggagaagaaaagaaagtctgaagacggtgattctgaggaaaagaaatctaagaaatctaagaaatgattctcatcactccatctcatcctatatatttaacagctttcttttttttcaaaaaactttttctattattagattagattttttttagtgtgtatattaataacgtaaaatttctttatcaacgacttgtagtattcttttacttttattttttttacatatgcaacgttatattcttttttaaatatccccatatactaatgatagaacttttaaacttttaggccattgacgaatttcatgacttcaaaacagtagttcagcaattggcccatgacattatttagaaacaaccatgatagcaaattctcatttgattttaagctaatatcgccgattattgcattcctgaatcttgtgctgcaatcaattaatttcaagcacgaaaatttgctttgtagggaaataaaggaacaaaaatctttaatcatttcatttaaggacttgcattcgatagacacagagggatcattgctaacgctcatagaggaatttaagaactttgttacgaaaacttgacagaacccttgtaaatgttgcattattgtgtttgtctctgaatttgtatcgtcttcattaatcatcatttccaaaatatcgtctaaatttacaatattcttccagtcattattcatgccacttttaaatataggaaaacttttcaagaagtttagaatgaattttaataactttattagttttttcactaatttggtaaaattattaataattgataacttcctttgcactagcgcttttggtaattctaaaacagccttattaatttgttcgggcaatagcttgatcatactttccagtttttgaatgattgagtcactgatctcattagaatgaattataaattgtgaaaaaaatttgattaaccctgtataggtgattaagtcacatttagttacccaatcaatcaatggctcagaaatgaatagattaaacatcgtgggcgatatagagttagagttagagaagaataatgcatttgatatattatcactcttcagaaacttgatgcattcataaacggagttgcaatggatatgatataatgactccaaggatgatataacatccgaatcagtgtctgtggggagtacacctgcgggaatttttgggaagtctaacttatatgatgtcaaaagcggatgttctgtgttcgataatatttgggtattatagttatctgatagcttgtcattacaattgaaaactttttcaattaaatcatgagtgaaagttaattcatctgaagacagtgttccggtagggttatttgccgctggtggcagcgaatctagtttatttgcttctgtttcgtttggatgctgtgattcgagttctggttcgttagggttgtcattactactctgtttaacgggcgacccagttcgagaaagactttttctatttaatgagaacggcgatgaaacgttaggtacctgcggcgaaggtgaagagggcgatggagacgataggggcgatatgggatcgttattgtgtactaaggataacgaggcattgttgttattaagggacacggagccgctttcgttgacagttagtttcaatccgcagtagtggtatttggattgacctctcatacccagccttctagtcgttaaatcaggaaaaactgttcttatcaacttccctaatgacgcctgtgataagggcttcagattgttttgggaacaagatgaagcgtattgagcaaatattttgccccttggtacgtaactatcatgctgagatttacaatttttcattaaccaaagtaacgcaaacacttgtctttctctttctctgttttgttccgccagctgcaaagctgcctttgacgtgttctgtgagtccatgctcaggactttgatttctgcatgcttcacgatctgcgcatactcctcgatggttttagatttgttattttctgcaatttgcttagcaattatttcttgcgtgtttctccttgaaatggaagagattcgtttctctcggcttgttttctgttttttagtactgcttggaattgaggggaaggtattagtacgtttggtagcagtaggaggattattgtttaaggtttcctctgacttgaaagaaagtgggtaagcagatgaattcgatctattcaggctgatagacgctggatacactgagtatgtggcaggttgccgttgtgttgcgggttgtgcaggacgctgtgtaggggtaggagatggtttatgggagccgggaccactaccgataagtggcggtaatattggatttggcgtctccgggcggggggaactttggtgtagcaggctgtatattgacgatgatttgctcgctatgggcgggatattcactgacatggggggcaaataagtgtgtgatgctggcggtggttggctgctgtacttgggtgcgtttaaactgtaccgattactgtttaccgaagatccgttacttggaccgttgctattgtcgttcgagccccgactagtaggttcaatgttattatcaccggacatgggcaaataaaattcaaaataatgaacagacaaaaaactaggcgagaagatgaagtacttggcaggtatttttctagtgaaaaggttttctgttggttgcgttctttgaagattaccatttactgctattttttttttcaactttttcccaaatcgccatgacaacacgaaacgacaggagaaaaattacgaaaacaaaaacaggttcaactgttgcagcaatagacaccacaaacgtgcgcaagaaaccgcaacgaaggggaggcgaccgtgcttgaaataaaatccgaagatccataggtgagccacgagtttggaatcaaactcgtggttttaccaacgaagctgtatatcgcggagtggcgctaccataggaccttcgtttttgcatacttagatggtcctgtaacaagaatagagctaaagaaacaagtatgcgtcgactgctgccacgcccggctgatttaggtgcacatcagctacccagcatacaaaggggcttccgtacggttgatggttatttttcttggtgtgttggtgctgctgtatcgctggtgctgtctgcgttattacgactatcgtaggacaaggcctcgagaggtgtagggtaaatcccacttgcacaaagtatgtacacacttgattatccaaataccaagagagtgtggttcaatttacgggcagctcgagctgcccgtaaattgaaccttccccttccccacgctcaaggggttcctgcgccggtgtttcaggggcaggacacgcggggatcgctggcacagtatataaacaataaaagaacaatggagagaggaggcgccattcaatatcagctcactagagtgcatagacgtatagacacaggaataaagatagaaatagggtaccatggagctgccttcaataaatagcaccacaagtatatccgacaaccaggagttaaggaattactatgacaagttgctgttcaagaacaatagtggcaagtcgctagcggatttgccaggaaaaatggcagattttaacgacaacagcgctgctgcgcatccccgctccagagttgactttatcaacggttacatcggtttcagagaggataagcagtctcttctggggcagaagaacactaaaagggcctcgttcagcgcatttgcggacgaaggaaggaaacagagcgagatgagcattaacgggaagagccctaatttgtctcttttctcatttgagtttaacggcaccccgactcaggacagaaagccatacaaacaggattacttgaatgtgatgaacacttcgcctaacaatattctttctcccttaaacaacagctcccaaaaatactatccacagaaacagcagcagcagcaacaaagcatctttgacccgggaagaagatcttcctatatttctgatgcgctgattcatggcaatgcggctacccagcaaccacaatactcgcaacctgtatatattaacaacaacccatctttgcaggtaccatacactggtccttccgagtatactcagcagcaacagtactcgtcacccttcaatgctaggcgcaacacccagccagtgctgaatttgcatccggcagccgctcccacaaacgatgccggattggcggttgtcgacggcaagaatttgacgtcatccaaggagctgcatgacttatatcttgactgcgggtcaaattattttgctagtgataaagtttataaatttattgacagcataaagggaactttacgcggggataatgtctccgcctccagttccaggattatagagtttttggattttttgaaaaattgtaatctgaattacaacccacagtctgacgcattcatctccactgctgtttcaaacgcttcgtcgaccggggcggccaaatccaagaacagcacttcaatgcatttgcactataagccattagtgttagtatcgttgaaaaatggtaagctcgaactgttgtctaaaccacaaacggccacacttatactgaaaaggggcgatttggtcattattgatggtgatcgtggtaaagatttagttttggtggtggaaccggttgtagatataaatttggcactatttataaattttttgaagaaaaaaattcactttgattctctaatcaccaatagtcaacagcatttccccaatgaccagtttatcaagactctggttgatacaaccaatggtaagccggtcgctcatgagttgaatccgaagttatatgatatcattgaactaacgcaattgatcatcccatcaaagcaggttctgagatttgccaccccgtgggaatcctccacgaatttacacaacaaattccaggatgagctaaaggctcttcacattgcacagctaaaactgaggtcgctaaataacaataactccggtggcgggttgaacatcaaaatattgaatgcagagttccaatttgacagaaagaaattgactttctactacatttgccaggagcgtaatgatttcagagacctgatcaaagaactctttaagttttacaaaacaagaatttggctttgtgctataccgaacaatttatcgatagattccaaattttatgattcaaacaagtttgagtgggagatgtatcaggatatgatgtcccactattccatggacaacactggaattgtcgtggcccctgaactgaatcgtttgaaactggacgacttccagatcggtgtttatatggaattggtgaaggttttgttcggctaacccaaacttatataatcattataaacattttataaacttatacacttttttaataatctctccatgttttttttatgtgttttgtttgacaatgacattactccctacaaacatgtgcgcgtttgtgacaaaaacataaataaaacaaaaaaaataaaaagtcaagtgaaaagcactgaaatctaaaaaataaatacatatacatatatatatatatatacctatttcgtttccgcatagaagaaattggaggcaactagttgcaggttgttttccttagcccatttgccaacaccggtggcaggggtgccgtaaccccagttcggtctatccttaattttcgagaacttagatgagtccacgcccttaggctgcttatataacaagaaaacatatctgtggggaccggatcccttgggtggagctggtcccatatattctattagtgtgttcgagcccttcgtattgaactctgatgcaaaaaattcggttgctccggaggtctcgtgagtagcctcattcaacagctttaagtcgcattctaccaagtggcagaattcagaccacttgtgatctgtcttagagggagcatccggatcggtcattaccagtgtgaacaaatcgtcgtcttggggaacgtacgcattcgcctgtggtacgcttttttgcatttgcttattgaacgtgaactggaattggggcttggaacgtgccttctcagtgggcagcgtgttacccatggcaacaggtgcacttgatgagtactctacggcaagtatcccggagggttgaaagcttgtgtcatgaattacatcctccagaatgccgtgcttcttgtaggagtcaatgcttgcttgtgcgaagtctattgcttggttcatgttttttgcttgttctcttgttcttgtattgatgcactggtagggaaaaggagcactgcaattcgcttcttgctgccccctttttatataccaattgagatctttccttccctgaacagcccctctatcccttaaaagatagaaaagttcaaagggataggaaaaatcaacgagccaaaaaaaaagaaacggaaccgttcggcatgtatatattcactatttcatatacgcgtttgcacaatatactctatcttatccgtatctatacgagccggttgctgcaccttacatgtcatagttgaaatcaacggtcgtgttttcgaccatgtaataattggcaccgaccagttgcagattgttctccttgatatagtcataggcacccgcaccaggagtaccgtacccccaggagataatgttctcaaccttggtaaaagtggacgaatccgctcccttgggttgcttgcacaggaagaacacgtatctgtgataaccggagttctttggtggaccaggcccaatatagttatttctcacgacacccttccccgaaatggcaatatctcccccaggtccgtactcgacaggaatatcagtgatgatgtagtgacaaacctccgaccacttatgttctgttctagagggcgcgtccgggtcagtcatcaacaaagcgagtttatcctcggctgacaattggcttttatcgaagggcgtgaacttgatggtaggagcggcttgcgtagcttccattggcatgggattgcccaatttgatgtcgtcagaatcaacgtacgaaaccgacaactcaccaagaatctcgaacgccaagtccttgacggtgtccttaatgatgtcctctttgttcagtttagcaacgatggcactagacataatatatatttctattactaagtactcggatgggtaccgaaagtggcagatgggcagtgtttactcaaacaattgatggcaacattcaattcctcacctggtgcgcacttccaataatgagcacgcttggcacttttatattgttcaaaaaaatgtcaggcaagatcttttgaaaaaaaggtaccgaaacggacgtaagacggaaatagaatttgaagataaagttatatatcactacacacgaatactttcttttttttttttcacaggaaaactgtggtggcgcccttgcctactagtgcatttcttttttcgggttcttgtctcgaggaaattttagcctcatcgtagtttttcactctggtatcgatgaaaaagggaagagtaaaaagttttccgtttagtacttaatgggattggtttgggacgtatatatcgactggtgttgtctgttattcatcgttgtttttcggttagcttcgaaaaaaaaatagagtaaaaaccaggaatttaccctaaaaacaagaaaaaataagataaacgaaaatatggccggtacatttttattcacttctgaatccgttggtgaaggtcacccagataagatctgtgaccaagtttccgacgccatcttggacgcttgtttagccgaggaccctcactccaaagttgcgtgtgaaaccgcggcaaagactggtatgattatggtctttggtgaaattactaccaaggcacagttggattaccaaaaaatcgtcagagacaccatcaagaagattggttacgatgattccgccaagggtttcgactataagacctgtaacgtccttgtcgccattgagcaacaatctccagatatcgcccaaggtgtccacgaggagaaggatttggaagacatcggtgccggtgaccaaggtatcatgtttggttacgccacagatgaaactccagagggtttgcctttgactattcttttggctcataaactaaacatggccatggctgacgcgagaagagatggctctttagcgtggttgagaccagacaccaagactcaagtcaccgtcgaatacaaggatgaccacggtagatgggttccacaaagaatcgacaccgtcgtcgtctccgctcaacatgctgacgaaatcacgaccgaggacttaagagcgcaactaaagtccgagatcattgaaaaagtcatcccaagagacatgttggacgaaaacaccaaatactttatccaaccttccggtagattcgtcatcggtggtcctcaaggtgacgctggtttgaccggtagaaagatcatcgtcgacgcttacggtggtgcctcatccgtcggtggtggtgccttctccggtaaggactactctaaggttgatcgttctgccgcttatgccgctagatgggttgccaagtccctagttgccgctggtttatgtaagagagttcaagttcaattttcttatgccatcggtattgcggaaccattgtccttgcacgttgacacctatggtactgcgaccaagtctgacgaagaaattatcgacattatcagcaagaactttgacttgagacctggtgtattggtcaaggagttggacttagctagaccaatctacttgccaaccgcttcttatggccatttcacaaaccaagaatacccatgggaaaagcctaagactttgaagttctaagcttttttccttttggacttttttctgccttcaacctcccatgttttcatttgctcaacacaagtcaacatgtacattataccgtatttgatgcagggacgcaataccatcatattcttgatatagactcatttttctcaaatcaaatttgtatcgatttcattttgcattatacaggattccttttcctttctaacatttaatacgtaactactaatattaatatatacctccttcaacggatcaacaaaccaaactttatcttattcaaatagaatttaacagatccaacgccttagttaactcatctttggcggtgggcaggtcttcataattcaatgcgcttatggcgtatttggcaagtttttgaatttgctctattttactggccctgtccataatttttgtcaactcatcctttgtatacgatttatgctctgctgcagcaggttctgatggtgcagaagggcgcgtaagatccacttctttcttcacaacttgttgttcgtcttttgttattgcatcttcgttcttgtcgacggtctgttcttcttcgtttacgctatcggcatcatcaataaattcaggtacctcatccacaggctcgtatgatgttgtttggtcttttggggctaggccttcgactttatcattattattgttttccaaatcgcttgtctggtgatcaacatcttcatccttaatctcctcgctatcatccgcaaaatctgcataatctaacgttttctcgtcgctggaaccaatttcaccctttgccaatttactcaaataaattttgcaatacttaattcgtttttgtaatgaatttgtactcgtttcacttatattttccttccacaggtgtaaaatgcatgaaaataaatcaatacaacaccaaagtgatctttttaacataacatcccagggaccatcttttagctgtttcagtttctcgttatacaacgacattgtaaaatttagcatataaattttggctttttcttgatcatgtattagcgtgttcataacgtgtaagcttttgtcactgtcttctgcttcactctcgccgccaatctccttcttaaacgcttcaatagtatcaagaagttctgtcgctagtgcggtcatctcttgcgaccgatcttcttcactcagtatcaattccaccgcatataactgaagatagtatccgatgatccctaacccaactttgtcaaaatccttcgctgtagcgacaacccttgcagcgttactagccatagaatttatttaaaatgtggacaattagtttctaaaaattgaatcaaataaaataagaaagcttattgttcctttttttgtcttcatctggaccgtttggataagatcattcaccaaatcttagtttttttttttagtttccttctccaacgatttcataataataaaaaaaaacaacaaaaaacacgattgagaaacatcaatatgaactaagcaatagctaaaaaaaaaagaataataaaggggaacacagtataattctcgagaggatggcgttggaagaagtggtacgatacttaggacctcacaatgagatccctttgacactcactagagactcggagactggccatttcctcctgaaacattttctgcccattttgcagcaatatcatgacacggggaatattaacgagaccaaccccgatagtttccccactgatgaggaaagaaataaattactggcacattatggaattgctgtaaatacagacgaccgaggtgagttatggatagagctggaaaaatgtttacaattattaaacatgctaaatttattcggtttgttccaggatgcattcgaatttgaggagcctgaaacagatcaggatgaagaagatcccagccattcgaaactaccagaaaacaagaccaaaagtgaaaattctaaggataatatcagctcaaagaggattaataatttacaagatatgagcctggattctgatgcacacagagaattaggctctcctttaaaaaaactaaaaatagatacctctgtaatagatgctgagagtgactccactccgaatactgccagaggcaagcctaacgatgatattaataagggccctagcggcgacaatgaaaataatggcactgatgacaatgacagaaccgctggacctatcataacattcactcatgacctaacttctgactttttaagcagtccactgaaaatcatgaaagcactaccttctccagttgtaaatgataatgaacagaagatgaaactagaggcattcttacaacggttgttatttccagaaattcaagaaatgcctacatcccttaataatgacagcagtaatagaaattcagaaggggggagctcaaaccaacaacaacagcacgtatcatttgatagccttttgcaagaggtaaacgacgcttttcctaatactcaattaaatcttaatattcctgtagatgagcatggaaacacaccattacattggctgacttcaatagcaaacctggaattagtgaaacacctggttaagcatggttcaaacagattatatggtgataatatgggggagtcatgcctagtgaaagctgtcaaatcagtaaataattacgactctggtacttttgaggcacttctagattatttatatccatgtttaattttggaagactcaatgaatagaacaattttgcaccatatcattattacgtctggtatgactggctgttcagcagctgcgaaatattatttagatattttaatgggatggattgtcaagaaacaaaatagacccattcaaagtggtactaacgaaaaagaaagcaaaccgaatgacaaaaatggggaaagaaaggactctatactagaaaatttggacctgaaatggataatagcaaacatgctcaatgcgcaggactctaatggcgatacttgcttgaacattgcagcaagattgggaaacatttcaatagtagacgctttattagattacggtgctgacccatttattgcaaacaaatcagggttgagacccgtggattttggggcaggtacttcaaaattacaaaatacgaacggcggtgacgaaaactcgaagatggtctctaagggtgattacgacggtcaaaaaaatggaaaggccaaaaaaataaggtctcaactgttgaaaaacccacctgaaacaacttcgttaattaatgatgtccaaaatttactgaattcaatctcgaaagattatgagaatgaaacagtgcaatataatgagaaattagaaaaactacacaaggaattgaacgaacagcgagaagaattagctaattctagagaacaactagcaaatgtgaagcaattgaaagatgaatactcactaatgcaagagcaattgaccaatttaaaagcaggaattgaagaagaagaggaaagttttagggaagagagcaaaaagctaggaataattgcagatgaaagttcaggtattgattgggactctagcgaatatgatgcagatgaacccttcaaagtagagttcctttcagatttcttggaggataaattacaaaagaattatgaaggcgatatttccaaactattagaagcggagtcgaaagagcagataatggaacagatacgaaatcaacttcccgcagaaaaaatccaatcgatgcttccaccaacggtcttattgaaggcaagaataaatgcatacaagcggaatgataaacacctaaccaatgtattggatacaatcagcaccaaacaatcagaattagagaataaatttagaagagtgttatctttatgtttgaaaatcgacgaaaataaagttgacaatatgcttgatggtttgttacaggccatatcttctgaagacccacaagacattgacactgacgaaatgcaagattttttaaaaaagcatgcttcatgagggcatgtgatttcattgcattaacttttatgactttatttgaagttatttttttgttttagcgctttatttacttttattttactacataactgtattcttacaaaatttttacgtactcagatgggatatataggcacttgatgttttattttcttgttcttatcatatatccgatggaataaaatgttctattttgctggctttttccaaaaatattgtttatgtgtccttctacaagatcttaagcctgtccttccaccttttaatgaactcaccaagtttcttctctcgtaatcatcatcgttttctaaatcgtagaaatactcttcgtccaatggtttgccggcggcgtccttaccatgacggtaaatgacaccgacacatttcgcgtcgctcaaaatcgaacgtaattcatctcttgaaagctcagaaatttgtgagttcacctgctgtaattggaataatggcgtctgctggacgtttgcaaaagctaggtgattggttaaaatatgctgtagatgcataacatcaatatttcttctagatagctcatccaaattctctttcaccgatttttttggctttgaaggtaagaccctcttgttaagttttggtttcttcatagtcataggatttttatcagatgatagtgaatcttgtctcagggtttgttcctcgtgatcaacagaggagacggatgaaagtggggacgatttagaatttaggaagtggtttagcatcctttctgcaacgccagaatcactaccaattgagattttgttgctatccttaagtatttttttgggtctgtccatcgaagtgtcagtaaaaatcaatggatgcttccttatactacccatatgtttcgtttcactttcactttcaaattcagctttcttctcgaatcttaacggctctgaagaagagtttttttcttttaacgaaatgcgaagtaaaacctgcctaaaatccaacatgatacccttgtaatatgtcatataaacggtgtctccctcttccagagtgaaattaatgaatcctccctcgtcttgaatttctttaacacatttttcgttagagaatctgggaacaagcctatatgccctattattgttattcatggtatcctttaattgataacaatcaaattgcttacgataggtaacgattaatccgttcatactgaagcagtgaatcttcacttcatttgtttgtggtaaataagttatactagcgtgtactctggatatgaacttattcttacagagcgcaacatcacattgcgaactattgcgccctacagtaatggtgctgatcttgctaggatctagttcagcattgatgactctagtatgccttgaaggagaagaaagtttggaagaaaacttgggtgacgtttctgccaactggccaggaaaagctggagaggaagggatggcgtcaaccttattcgacctaacgggagacgaaacccttcctatactggaagaaggaaatggagttggataatctcctttcccgaaatttccaattgattctgacgcagttttaccagctttctcataattggatgagggacaattaggctgctgtttgtaatttggtggagagtacggatccactgtcctgtagggggacgaaggaaattgcgagctcatgccttcttgtgattattaatctttgatgtgtcgtggcagatgtatatggacttttgtacgtaaagtagattgctataattcaattctaaatgaatgaaagtagagaaagagtttccattgatgaattttagtttacgtcgactgccgctgttcattctcatcaaaacacgaaagcaaaccatagagatgaacttaagaaaaaagggccacgggatttttttttcgcgttttggcgttttcatatcaaaaaaaaaaaccatattaacatctgtacattattattaactaaacatccgtacacaaaaggttttccaagacaaaacgttgtcgagactattctctttcgaagaaattctaaaacacacttcggcaggccggcaacaagaaggcggccccttggggaaagggaagtcaatccgtctgcccgttctctaggctgatggtaggcagggcgatgccatactggtgaagtgtggtccgtcggtctgtctcctccaaacgttgatgttctcctggtagctttctcatcaccgtcaatattacaagtgtaagaatgagaaatgctctatatgagggtactattaaatttcaaaaatgtttacttttaagaggtatttgctaaagcctcatacaaataatatagacaaaaatgggtagtatgtagtaggacattgagaataaaactgtgaacctgttattgacgaccgtggagaaatgttatgattatctgaagagaaatatcggaacgcatgcacaccaaatttatacttagcaagactggacgatacgagactggtatacttgtatgaagacagaatagtgaacgaaagacatgcgcatgacaacaaatttaccgtatagaagaaatattctgcttgtatgcctgagggaactcgaaaggatcaatttcaatggcgttgtaacagtcacgaaaaaagtgtaactataagataaagcaaattgtactaacaaacttaaccaaattgcacaacaatttgattttctttttaaatagagggtactccttcattcggtaaacgtcacaacaagtcccacactttgtgtaacagatgtggtcgtcgttctttccatgttcaaaagaagacctgttcctcctgtggttatccagctgctaagaccagatcttacaactggggtgccaaggctaagagaagacacactactggtactggtagaatgagatacttgaaacacgtttcaagaagattcaagaacggtttccaaaccggctctgcttctaaggcttctgcttaatttttatactaagatctatttctttaaatgaaaactcaataattagagaccttatataataaccaactgcaaaaaaacttctaaacaattagttaacaaatctccagcctttttttaatatatctttattcatatgtaacgcctttgagtgcttacgggaaaagtagaattgatagtttcgtaattcatgaccggaaaaagtgaaaaattattgttcgatgaatatatacagagatgtcttgaactgtttttgccagcatcattcgttatagggagcaaagttagtgcaacccagttaccagatatctagtcaccaagaagaaaacccgtaaaatcgtaggtcatggtcgaagattccagagttagagacgccctcaaaggtggtgatcagaaggcattaccggcctctttggttcctcaagcacctcctgtcttgacatcaaaggataagattactaagcggatgattgtggtattagcgatggcatccctcgagacacacaagatatcgtccaacgggcctggtggtgacaaatatgtccttttgaactgtgacgaccatcaaggtttattaaaaaaaatgggtagagacattagtgaagcaagacctgatattacccaccaatgtcttttgacgttgctagattctccaatcaacaaagccggaaagctgcaggtctatattcaaacaagtcgaggaattctgatcgaggttaaccccactgttcgtataccaagaactttcaaaagattttcaggtttaatggttcagttactacataagctttctatcagatcggtaaattctgaagaaaagttacttaaagtcattaagaacccaattaccgatcacctacctactaagtgccgtaaggtgacattatcctttgacgcaccagttatccgcgttcaagattacatcgaaaaactagacgatgatgaaagtatatgtgtctttgttggtgccatggcaagaggtaaagataactttgcggatgaatacgtcgacgaaaaagtcggcttgtccaattacccattgtctgcctcagttgcatgttctaaattttgccatggcgctgaagatgcttggaatattttatagtgtttaagtctacttggcatcctctttgtataataaacagtcaatatacgatatagaaacaatcgagttagcgattaattcgactgcacctctatccttcccccacgcgaaataatggttcggaagtcatctgaacgaggctcagtctttgaatatttcacctaattcggaccctgaacggtgaacaaaatttcaatatgatataaacaaaacgtggaagaactcttggcaaagacaaaggataaagagctcgttggaaaagtttttttacaactgcaaacggcacttaatattgctaattaacttgccagtatcatttccctagcgccttgccgatttggtctttttggcactgtttattcttactaaacgatattcgtaaaacggaaatcaaagaaaaccaaaattgaagtcccaaagcgtggcaataaaagaacaagtaactgcaagaacaccaagaagctacagtaagaaatgaaaaggattttctctggtgtgaagtccccaaagttatctgctcccccaaaagttttcaaaaatgatgagagcccatccactccgagctctcccaaattcgaccaagggcttcgaagtttatcagcatcagcttcaagactcttcagtaactcaatatccactcctgggagccctacgttagatcttccgcaagaacactctattaatggtgatatctcaccagaactagtaccaatcgttactttactctctgcacaggctcataggagataccattatggtatattcttgatattacatgatttgaagacagacggaacacctgccgcgcgtcagtgggaagaatgctatggtgtgttgctaggaactcagctggctttatgggatgcaaaagaattatcagattccaagaataataagaacacatcaaccatgaaaaaagccgcatcgagaccttcttttatcaattttacagatgcttctgtgaggagtttggacgctaatgatcaggtaatcattgcatcagagaacgaaaagacaaagaaagatctagacaatgttcttgttgtttcaacaactttaaaaaacaggtatttcttaaaattcaaaaattcaaaatcattcaaaacttggaacgcagcaattaggcttagtttgttcgagtttacggcgttgcaagaggcctacacgggctcatttttgtcaagcagaggtgttaaacttggtgatatcaaagttgttatggcagatacaaaattcacttatgaggactgggttagcgtaagattcgggacaggtatgccatggaaacgttgttatgctgttatttctccacagtctggcaaaaaaaagaaaaattcgaaaggttcaatatgtttctatgaaaataacaaaaaaaccaaaaaatcaaacataatgacaacggtagtagatgcacgggctttatatgccgtttatccttcctcgccgatattaatcgacacatctacaatcataaaattggaaggttttgtctcttttgacaaaagtgaggaacctcaagaaaccaacctatttatcatgcctgaaaagcatcaaggtgttccgggatatgacactattattcgcttcttaatcccagctatgaacgcgttctacttatatggtaggccaaagggtttgattgccaacagaactgacccagactccctgctgtttgccttacccactcttccgcatatatattatttgcaggtggatgacgttttatcattaacaaaagacaaaaattacatacattggagtgctgctgattggaggaataacattgttcaagtattacagaaaaaattaagtaagggctataaaggctgtggtaataaaactgtatcagtttcatctgggatgatgaagtcgccggcaattagttcagctgaattatttgaagggtacgattctctccctgaaagacaaatggaaagtccgcaaaaatctaagatgaagtctcctacattagcatcgaccgatgatattaattccgcttctgcttccgtaaactcacatgctacctcagtaaaacaaactgaattatttgtgactgataattcttcaaaaatcaatgactctgtgtcggcgcagtccagtgtcactactaacttcaaagatacttttaccaccccaatgacatcaggaatgctcaaccatgaaaattcagagagaagctttggttcaggattaaaactcaaaatcactgattcaaatttggaaaatatggaagacgttgaagcgaaatctgctaacgaattctctacgacaccagaagacaaacatattcacctcgccaatgcagccgaattatccgccctttacgacaaatattccacatctccgtttggtaaatcggaggctaattcaagccctaaacctcaaaaattggaagttaaagatcggtcaaaaaatgaaaacagaagcccctatgagagatacgtaggtacatccgctgaaagcaagacatttgaaataggtaacgtcagagagtcgaaaagtacgataaatacttccctttcttcgcctttgagggtagaagatagtagacgttcaaaaaatgaggacctgggatctttgaaagagtttgaagagttatctcaaaagattagcaatatgggaatggcaaatatttcttcagaagctttaagtgacacagcagaaaacagttcttttgttacggacctgaacttgaatatcaataacagttcatcggtcaatctcaatgaagaacaacgtgtgccggattttggggaggaaaacgtatttgatccagattatatggaacaaaaccaaatgttggaaacagaaagtaggtacactacggatgagtttgacttttcagataatcaggatgcagcatccagtaattatagcaatgggcaaaccaaccgaacagtaactgaaaccctttctgccagtgacagaaatgacaagatcccacattcttctttatttacaaacttaaaccagcttacttcgaatggaggaaactatcaggatagggaagatttctctggtgatcaaataaacaaacctcaacaatctcaaccacttcatgtgaaaggaccacaaacttcgtcatttggttacagaaattcttcagccaatagctcgcagcctcaagcaccatacccggttggtcgcccgttaggtaagataagaacgggtccgctgaccgtccagcctatgcaacaaggtggaaactcatcaatgtattctttccaatcttcgcaacatcggtttcattcgtcgcaacagcgccaaaaccaatcactttccttcagaaacaatacctatggaagtggtaacaatcaaaatacattccatccatcgccgcaactgcaacaacagcctcaaaatatgagatatttgaataataagttaccaataaatgatagatctccaataccgcaaacacagcaccatgtaccagatggccgtcccagcctccatataaataccactaaccgcacaaatccgcttactgcacaaagtggattttctcaatttatgcctcccaatagcacatcaaccaacccatattccagctgattcatttatatttcatcttttctttttttttttacaattcagtagttttatataacttcccataaatgtattatttttttaatacgactataatatacctctatacccttatttatctctttacctttgcttttaagctaaacaaatcttcattaacaggtattatattactggcgtcgcgtttcgtttaggcgcatcgagccgagacttcagaatcacaaatgctttgtatatatgttacgtattcagtattgcccaacatgcaactagattcaactaagcagacgtgggtacttacatgagaagcagatcattgaaattttactaagttaaagaagaggaagggctccaatgattgtaagaatgatacgtctttgtaaaggtccaaagttgttgcgaagtcaattcgcatcagcaagtgcactatattcaaccaagtcattgttcaaacctcccatgtaccaaaaagcggaaattaatttgattattccacatagaaagcactttttgttgcggtcgattcgattacaatcagacattgcgcaaggaaagaagtccaccaagcccactttaaagttgtccaatgcaaattcaaaatcctcggggtttaaagacattaaacggctattcgtcttatctaaaccggaatccaagtacattggtcttgccctccttttaatcctcatttcaagttcagttagtatggctgtaccttccgttatcggtaaattattagacttggcttccgaaagtgacggcgaagatgaagagggctcaaaaagcaataagttatatggtttaacgaagaagcaatttttcacagcattaggagcagtatttataattggagcagttgctaatgcaagcagaatcatcattttaaaggtcaccggtgagagactggtcgcaagattaagaacgagaacaatgaaagctgcattagatcaagatgccacatttttagatactaatcgtgtcggtgatttgatctcaagattatcatctgatgcatctatagtggccaaatcggtcacacaaaacgtctctgatggaacaagggcaattattcaagggtttgtcggttttggcatgatgagcttcctctcgtggaaattgacttgcgtaatgatgattttagcccctcctttaggtgctatggcactgatatatggtaggaaaatacgaaacctatcaagacagttacaaacctcagtaggtgggttaacaaaagtggcagaagagcaattaaatgctactaggacaattcaagcatatggtggtgaaaaaaacgaggttcgccgctatgcaaaagaggttagaaatgtatttcatattggtctgaaggaagcggttacttccggtttattcttcggaagtactgggctagttggcaacactgcaatgctgtcgttattattggttggaacaagcatgattcaaagtggttcaatgactgtcggtgaattatctagtttcatgatgtatgccgtgtataccggaagttcattatttggtttatcgagcttctattcagaacttatgaaaggtgctggtgcggctgccagggtttttgaattaaatgaccgtaagccattgattcgtccgactattggaaaggatcctgtgtcattagcccaaaaacccatcgttttcaaaaacgtgtcattcacttatcccactcggcccaaacaccagattttcaaggatttgaatattactatcaagcctggtgaacacgtttgcgctgtcggtccatcaggaagcggcaaatcaacaattgcgtctttgttgctcaggtactacgatgtgaactcaggatcgatcgaatttggtgatgaagacatcagaaatttcaacttgaggaagtatcgaagactaataggatacgtgcaacaagaaccactacttttcaatgggactattctggacaatatcctctactgcattccgcctgaaattgcggagcaggatgatcgtattagacgtgctattggaaaagctaattgcacaaaatttttggccaattttccagatggattgcagactatggttggtgctagaggcgcgcaattgtccggtggtcaaaagcaaagaattgcattagctagagcgtttttactagatcctgccgtccttattttagatgaagcaaccagtgcccttgactctcaaagtgaagaaatagttgccaaaaatcttcagagacgtgtggaaagggggttcactactatatcaattgcacataggctttcgacgatcaaacacagtactagggtgattgtgttaggaaaacatggctcagtggttgaaaccggttcattccgagatctaatcgccattcctaatagtgaactaaatgcgctgcttgccgaacagcaggacgaggaaggaaaagggggagtgatagatttggacaatagtgttgcccgggaagtataagaagttgccgcagtatggaatcacttttctatgccacagttatggtatgtgttggaagacaattaattatcgcattatgtttgctgaatatgaaattgtgtattctataatttaaatgatgcccaatgtaatttacacaaacagtttttttttaaagctccttgtacgcctttatacacattaaattaatattagatgcacaacatacggtacgtttaggaaactcaaattaagctttatttttttacttttttattattgttactattattcttattatcaacattatcgttttcatatctttcctgagtacaaatatgactgaaacttacaaaaaaaaaattaattatttattactattaatgattagatgttacgcttttttataaaagtgagagtgatactcggtttaaatcatcgtccacccttcatccgttgtttcagcaggtgtcagtttggttgcatctacattttcctctttcttgcgcggagttttcactcttgataaagtaacgcttcttgcatactcaagttcgttgtaaattgcacttattgcagttttaatcccatcttctttggaaattttcttctttattaatccagctctatccttcattattttgttcgtcgtagctacttttaaagcatctgctaatgtttgagcgttaagtttctttaaagcaataccaactccaatgtcttctactctacctgcataaaagaactgatcaccaaagaaaggttttataacagtaggtaaaccagcacgtaatgaagctccagtagttccagaaccaccatggtgaacggcagcatcgacttgtgggaacaaccaatcatggggaacgtttccgatatttaaaatgtttcttggaagatctacctctgtcttctttgccgccttatcgcccaacctttctgaccatcccttatttaaaatgcagtatacatctgcttccataactgcttcgacaagagcttccgtcatttctttggcattagagactacaatcgaaccaaacccgatataaaccaatttttttccttttgatcttgcctcagaaataaattcttgtaattctgctggcggtttgaaagtactcttatcatcaagaaaccaatatcctgtaactctcacccactcgctaaaatcaattgatggcggaaaaattgtaggagaaacattgtataagaaaggaacattattctgctgtaaaagaaaaagatttgttttccctaaacctagagtttcaactctccacttgtttacttgcccactaattcccttccagaaaacgttttcgaaaaggacatgtgtcaggtagttatagttaccgccccttttttgatctggtacaataaatgcatgtggatatgctcttgttcttgtccatggcatggtaaatgctcgaaaataaggaatttgcaatgcttcagtaatatgaataccaaccatagctgagggtgattcaatcagaatatcaaattttcttctgttacaaacctcccaagatgtctgtaaaagagcatcgatccatcccctaaatttgctcgaagcttctctcagcattttaacattcattgattcattttccaccatcaaggacatcaactccactgggttaccagcaatctcttcaaactggattccatgactttcaacaaagtctctaaattccgaatgtgtaattattaccacttggtgaccttcttttatcaagccctttccaagtgcaatatatggttgaacatcccctcttgagccaatcgtcaataatccaaacttataactcttgtttggttttatgcttgttttatagtgcggattctcatcaatcattaacggtacctcaaagccctcggcattaattttatcttcgaaaagcttcaacttcgctgagtcagggttatgctgaacatcgccaagagaagcactcgatatattcgatccttctgcactgcttgcatatatgttatctaagagctttaaaagaatgcgttcaatatcatccctggcgacctcagtgctaaattcaaaaaatagctcctcgtgaccgtgaattactataaccaatacaaaataaccaaatcgaaatcccttttctttatagcatgtctccacatcaaccaatggcaaaaccatgtatgtattagaccctggtaataacgatctgaagcacaccgtatcattggatacgtaaatcttaccataaacgggaacatttctattcaggtatgtgtagtaagtactgattagtgacttctctttattaaacttgaaatggtacctgaaccgctcgttagcagaaacctcttctgtttctttaatcaaataggtatcatccttttgaaacgggataaacttgttccggtagtgtattggtttggcagcccacatttcggcaaaatttttgaggtgacttggcttccaagctacggtttgctcttgactatcttcttgttcatgaatatgaatcgtggaatgcacagaagagtctatatcattcgccgcatctttatatatttcctccacatcctcaacttgagaatcttcaagaggtttagctctacgaaaccaactattgcttctttctctaaatctgaatcgactctttttcccattttccgaagaaggcacagccgaagttggaacattcaaatattttgaatcctcgccgttattcttttgctcaactgtagctggtgtctcttttccaaaacttgattttgatttcttggctggaatatcataataaagtgtattaacaccggatttctgcaatatagccaactgttcgccaaggctctctttgacctgactaccggacccatccatgaaaacaaacatgaaatcatcgatagcataggtctgtgagctctccaaagctcttaatctcaatgttaaagctttgttgactataggttgatcatctatctctataatgttgggcagcggaatttttaaacttatcgaattgttttcagaattctgagctgcgaactgctcctttttcaaagcgttcacccacgatttagcggagaactctgaatctgcattgaatttgaatgtactttcatctgtgtaaagcttaaatgttttcgtagcactcccgtttaaggtatgtttttgtgtttcaattttttggacctccctcaaatctatggttaaaaccggaaagtatagctcagttgatgaggtatacatagaaaataaatgattctttagtacgcaccaatacctggtagacctaattagttttgtcctgatattaaggtttccagacattttaaccgaccgaggattcttaggtaaatatgcaaagaataggaaatgttttgttgtaataaaaatatggccttgaaccaacacatctttaagtagccatgcagggaaatcattcaaaaatggttcctgttcgtctaaacaaaaccgctgtctcaacttagccacattgtcttttgacagtttttccctagttattgagaagtcgaataaagttggctttcttttgtctaatcttggtacttccggatgcgatttagttttgagattttcctttttgctttttacctcatttcgaccaatgttttcctggaaactatcactggaatcagattcttcagaatcaacttgcgacaacacattcatttcttgagcattattcatccctgcatacacactagcagtagttaataaaccggcaatacttttcatcatatacttggatttcgccaagtcatctgcattatcgttattgtaaccgttttcgtcatcatcactacgggcttcatttggactgtcctgcagttcttgctgctcagacgaccccatcgataaactgctatttgatcttcctctccagcgcttgaacttcgaaagtgaccttgaaaggcgatgatgcctaggggaagtttctggctcagatggcttatcaggtaccaacgaaatgcttggttttggccccgcctcgctatcagacgctgatatgatttgagtgatgggcattcttttaagttatacggattttcaccaaagcataaagtgcaactgaacttctgatgtttactttttgacagccatgactttatcagtgataaatgcaatgactttccgatctactccttctgttgacttttagtcccttttttcttagatgttatgttacagtcacatcagggttaagtttttccaagtcatctcaaaacaatgacctattttatttctagataaaccctggtgtaagcagggttaattttgtcccaaacgggcaaaatataaatacccctttcgggaaataaactaaaaagagttctaattagccaattggcaagaaagctcgatgaagaatcattatgggtttagaaatcagatttccttactttacaagttctctcacgcaagcttgatcgtttttaaattttctacgttcattcaagacaaagtggttacagatagaagtttttctcacatttagattattttttcctgatagtattaaataacacgtacgatcaacaaattgttgctcagtttaagtgagcctagagaattaagctttattactgctgtattttctgttattttgattgccttgggaataaaggaaaggtttggaggggcacatcttcctaaatagcagtaaggaaaaagaatcgcgtgtgaagtcttttaaatcaacatagttatcctcggttccaactattttactttcgtttcaattccgttgttcttaactaatcttcttttcttttaacttgttacaagccagtactcattgcaaaatcaaaaaaaaaaaacacaactaataaactaaacaactaaaaaaatgaattctccaacaatgaaatcggaacaacttactccaaaactctcaccaatgtccttttgtttggatgaccaaagaaatgcaggctcttttcaaaatctattgaactcacctacgaagctaaaattagacactggcccgattggtaattccttgttatatccaacatcactctctaaattgagcgagttatcaagaggtggacgttctaaacaaagaaggggctctgacactatgaggtctgtatcgcctattaggtttcagtttttgaacaacactccaaagatgttaaaacccgagtacctatctcaaacaaccagtaatctgccattgctatctgccctattgaagaatagcaagaaaactactagtgaaggccagaattcaaaccctgatccattgaacatagagaaaaacatcattaaacaaagcatcaaggacaaactagagcagctgcgcagttcagaatccgttgcgcaagtacaaaagaaagaacgcaatcccccttcatttgaggccaaagtctgtgcggaagaaccgatattacggaaaaacgccgaagggttgctcccctcatacgttcctgttcctgctactcctttggaagatccagaaaatcatggggtgcgaaaggtcgaggacaaaggacttagagtcgtctccggcggctccactcagtgtctaagcaccgaagtgaacgaattgcctaaggatctgaatctagacaatttacctacggataataacgggttcgttcaatatggtctcaaaggcaataacaacaacaacagatatagctttatctcgtctacgtcgacggactatgagcccgaatggtgtgacggacaacaacatatttcaatgcaaatggcctctatggccaatgcagaggaggcaaatagtcgtgaaaaatcgaatttagacataaagatcaagcagctagaacttgaaattacagaattaaagttgcagaatgaaaaattagtgcattccatgacgacgaacagatacattgaagaaagatttatgcttgaggttatgaaggatcctagtatacaggctcaaagatcccaaagagatattgagagaaaagtcaagcaactggagaaaaaattcttcaattgtaaaaaagttcttaagaaattgactgaatcctccgcagtagtggccacctccacttcaaaaactgaaggaaattcagcaagaatcccatgccctaagactagactggcacgcgtttctgttttagacctaaagaaaattgaagaacagccagattcttcttcgggaacttcgtccgaggaagatcatctaacaaacgatgatacggatgctaatactagcgaagatttaaatgttgcttttgaagaggagccaacttctgctatttccacaacagcatctgtgcagagtggggaaagtaaaagaggtttccaacttaaccttcctgtccaagtggagaagaaggaaaaatgaagcgtcaacttcaaattaaattaacttattttacacaaacattcacaatacatcaatgctgataggcgctttgtattgtaggctatcgagttacgcatctgcaatgtgcgtgatttctccgttatccatccttctcattggacaatttttatttgaatattactgaacttcaaagggcttgtcgtgtgatttaatcttttttcttacaacgtcgaatgctgcagctatttattcatagtgtcgtctaagcaaataccccgcttttaaaagctgaatagaaaatccaatcacggtgtgactggtatcacaaacacataatttatatattgcattcaagtttattcaacctatacttaaatacattaattaccaaaaaaaatgatataataaagtcttcttttatctgattaatgacacctttttcagcgggccaaattttttttatttccgaagcccgccggactaatattaattatatcagatagttggtgagcaaacgcatgtggaaatgaacaacaatttcgaaagtgcatatactatctataaatatcaaggggattctatactataacaatacctgcgatgtcatccacagcagtaccacgacctaaaccttgggagaccagtgcttcgttagaggagccacagcgtaatgctcagtctttaagtgcgatgatgacctcgaatcagcaggattccaggccaactgaagaaagcaataacagtaatagtgcaagtgagtctgctcccgaagttttgccgcggcctgcggcacttaactcctctggtacctacggcgaatcgaatacaataccgggaatatacggtaatagcaattatgggataccctatgataataatccgtatagtatgaactctatatacggaaacagcatagggaggtatggctatggaggatcgtactatggcaacaattatggatcgttttatggaggagggtacggtgcaggagcgggatatggaatgaataatggaagtggactaggtgagtcgacgaaggccacctttcagttaatagaaagtttgataggcgctgttactggatttgcacaaatgctggaatctacttatatggccacacacaactcgtttttcaccatgatatccgtcgcagaacagtttggtaatttgaaggaaatgctaggttcattttttggtatctttgctataatgaagtttcttaaaaaaatactctatcgtgctactaaggggagactaggaataccaccaaagaatttcgcagaatctgaaggaagcaaaaataaactaattgaagattttcaaaagtttaatgatagtggtaccataaattctaatgagaaagccacaagaaggaaaatttcatggaaaccgctactattttttttgatggcagtatttggttttccatatctactaaacaaatttattactaaactacagacctctggaaccatacgagcatcgcaaggaaatggtagcgagcctattgatccttcgaagttagaatttgcaagagcgttatatgattttgttccagaaaacccagagatggaagttgctttaaaaaagggcgacttgatggcaattttgagtaagaaagaccctcttgggagggattctgactggtggaaagtgaggacaaagaacggcaatattggctacattccgtataactatattgagatcataaaaagacggaagaaaattgagcatgttgatgatgaaacgcgtacacactagtgcatcaatatttgcacacatatattcgcatatatatatagtaaaatctaaagtaatgtaaatattccagggagaatcagcagaaacgagacgaagtacttcttaacaaaaagccagataacggtgcaaaaacacattatattctccatcttgaaaacacaatctcctacgtacacatatgcgtatttatttttatatgaatgaaacgcctatggatatatatatgggaatatagacattcacaatttcaggacaattgtgatatggcaatatccaaggcctgcggtgctgggcttcgctttttttcaccaacaaaatgagatggacaagtttatcatagcaaagaaacaataagcagattacataaagtcgtcatcaccgaattcaaaatcgtcggggccatctaggtcgaaatcttgatctttcttaaatgcgccacccaaattggtcttacctttgactttcttcttaccagcacccccagtagcagtaccacctctaacacgggccagacgagcttgcctctcctctctttccttatctttgatcaaaacgttcaaagtagcaactgtttgtcttatagattcgatggacattggttttgctacatctctaatcaaatcaatcgctaacgatgaggagtagttcagcggagattttttgttcattggtgtaatagcagcagtaagagcctttcttaaatcctggtactctctctttgtttcggcgttaaacaaaggatgtgtttcgataggtgtgtccttggtaaaggcgggtctttttagagcttgttcctcttgttccttttgtaaagcacgagcccttggatgttcttcggcaacacctaaacccgcaaacaaatctgcagcattgtttaagtcagactccatttcagcctttttgattaattctttacgtgtcttttcatccaatgtgtcaatatccaatagggctctgtcagcggaggattctttcccttttttaaccttttttggttgttctttttttggctttggggcaggcttcttttcttcctcttctgcatcccatgattgcatgacaggttcgtcatcaccaatttcagcatcccatgagtccatcaaaacggcgtcatcattacccatagaaccattgatagcttcgtcgtcccaagacatttttattactttttttttttgaggtggtggttaggatagaatagttacaaggaactcaaaagatagtaagataatttaaagcgagagttcaagaatggtgggagcagtcagttctcaattctttaatgtagtacttctgacttagctagcatgaaaaaaaaattcggaaaatgcccaaaaacaggtgtgttcgtctaatatgatacagggacgaccataatatcaagattagtgacatttgatgtatagtttagcagaatgactgttataaataaataattatatatgtgtgtatattaaattttgttgaaccagcgcttatttacaatttttaggacgtgaccaaatgcgagctgcactagttttctcaatttcgctcgcccatggtgatatctttaaagatctttaaatgggaacatcaaaactgaggatttctcgcctcttcgagtttttggataacaaatgccatgcccattctgcttttcttaacgttttcgtcaaatttagtgcgcgaccaatcctctaccttagatttgatacccatattgaagccacttgaaaacttcacccggctgtctgctatcgtactacttgtagcactgtcaaattgataggtagtatattcttcaaccttcatgattccagtgtgatccagattcctagtgtaagttttcattgtggagttagcggggttcactacggaaacttcgattatccatgtttctgttatacctcttaaaaagggtttgacccatgtgggcagctttccggactttttcaacagcctcgttgtgcgcaaatttccttcttgatcaacgttccttgatattgtgtctatggatagtacatggggggagtatggattggggtatctattaaaaaaggcgcgtgaaacagaggcaaaatcggtaggaaatatatgtgtgcttttgtgtaaaaggaccattgcaactcttaaggatatcttaccgccgtctcagaagccagacaatacttattgaatatgattactcatccatctgtcatatatattttttttttctagcttattatccagggagagcgagaaatactgcggagtttttcacccgaaagaaaaaaaatacgcaagcacgatgataacaatagttatattattggttacctacagtgtataaaaagaaagagttttattaaaatgcagaactatgtggtggtatacagaactgattatacattctataacaaaagggcaccaacggcgaatgcacccgcaccataagctatgtgagtgccggcaaaggcgccattggtagaattggacattacggacgctaccttaccgttgactgtagacttgtatgtagtggtcagtgtctctactgtagaacctgacgtagtggtataagttgatttgatagtgcttactaccttggtgcttgattccggttttgatgaggatcccgaagatgatttacttgatgaagccgtgttgtcagttgtggctgaggacggtagccaccaaacagtagatgtgtaagtctcacctaacgaattcgtggtagttactatagtaactggcccgtccgttgatgttgatgtcgttgaggaggatgcggagttggtgattccgcttgacgtctctccggtgggctgcacagaggcagttgaagttgtgcttacggcagagttgctttcggccacccaccataggtactgtgtcgtggttttgccttgtgcatccgtcgtcactacggtggtacttggagccacagcataggtgttgctgacgacgttgctagtttgtactaagctttttccggtagaaactacagttgatgcgctttcttgggcttcctttgtcgtggtaggtgtgatctcttgagagtttgagctttccttttgtgagctatcttcagagttctggccatctaaggaaccagagtctttttgagcagcggctagagtaattaaggtggtaaataatatggaacaggccttcattttatatatatgttgggtttgtttatattttcactagatcggtgagtatctagtccagaagagttgatctttcttacatacttatatatgctcactaccgccttctgagaaagtaggcgtttttcagctacctcagtcgctaaaaataaatgcgagttctcaagccaacttggactccaaggcggtaattatagtgattctctttgtctatttttggatttattttggaggctgacactctaaagccagccattggattaattattttttcacttcgtcaattgactatgcggaaaaactaaatgtggtcaaattctgtcggctatgtacacgaaaactatatacgcctcgtcctttcagccactacaacataacaacaccgacattgctacgccttttaatgtcgttactattgtcgggattcaagccaccggtaatcggctttgctctataattaaataaatagaagttcaagaacccgtcaccgggcccgaacttcaaatcatccaagaacaatgtattatcttgcgaagtcaacgcgttaaaaacatccatattagcgtttttggccaaaatacaagcgtcataaatcaattcacacaatcttgttttcaaagccttagtagcttttggatcaaacctgtctttgaattggaaatctgcatcggtggcataataatacaagtacccgatgcctaggtccttatattttgtgttatttaggattgtgaatggcaatgagtaaaatgagaagaagtctgtaatttttccatcgggctgttcgactacatatgagaaaattacttgtttatccaatggtaacgattcttcaccaatgaaattatgttcgaattcttcttttgtgaaaatttgaattagttcgaacctggattgatatcttttgaacaactcaaaaacttggtcaatatcttccttctttaattttctcaatcccgctgtctttgttttggccggtaacgcattctcagcaatcatatcctcctctgtgtgcccatctggtaaccctgtgaaatctacttcataaagtttcttccaattcaagggacgatgagtataacgacacgtactcacaggtgctggcaaaacaatacctgccgtgtacaatgcatgccagatgtcacatttgttcactcgtctcgtaatttctttaattagaacaggtgttaatctcttcgatcttagctgtttgtgaacgcacaagaaattgatttctacactaggcacttgtttacctctaacaccaagtgttactggtatggctgagataaaggcaactaatttctgtgtttctttaacgcgaacaccaatatgccaatccttcttccaacctggactctttaaagcccaattgaagaattctttggtatagttaaatctgaagcctgcatcgcggtcttccacgtagttttcatttagtagaacgaaaacatcttcaagctgttttttgttgtccacatcaatactacaccattcgaagctagacaataaaggtagtggcttgtcagatatatcttccggtgtctttggcttatcaatggggccttcttccaccaccttttcatcgaaatctttgaccggttgcgttctccagaatttgtggtctttcatagcttttttctgttcttgagtgaattttgaagtatcgtcattattcaactgtaataacttcaataaattctctaattttttcgctttatcctcttctgacattctataaatacgtttactaccgaagctctatgacaaccagagctattgtacagatcattctctaaaaagcgtgcaacacatatcatcttcaattatagtgaattacttttatcatgagcaacggctgaaattattttatcctattgttttatgacagtatcctttcaaaagagtcgaaaggatcctctgttgcaagaactactattacgtaattatacatagtccgcctgcaatttctagtgagactttgctttgctttccactttgcgattaatattgagaattttaaacgttaactgaattcttacccacccataataagaactctaactggcgaatttatcatgaaacaaatctgcaagaataaaaaattagagaatcgtgcaattcaatttaattgccttgtccgttgtaaaacttttccataggccctaccttgagttgatcatatgtattattctatatatattatatccagtcgggtaataaattttctcgccctcgaaaaaaagaagtgaaaaatttgtctcgatgagctgagatgagtttgaaagaagcaaagagttttaatttgtaaacgatagcaagtgtaccctcagttgagtctattacgccttccttatttggaaacttagaagacgaataaaaaaaacaaaataactaatgatttctgctactaattgggttccaagagggttttcctcggaatttcctgaaaagtatgttctggatgatgaggaagtggaaagaattaaccaattagcacagttgaatttggatgatgctaaagctactttggaagaagcagaaggcgaatcaggtgttgaagatgacgccgcaacaggtagttctaataagttgaaggatcagttggatatagatgatgatttgaaagaatataacctggaagaatatgacgatgaggaaattgcagataatgagggtggtaaagacgtttccatgttcccgggtttaagtaatgatagcgatgttaaattccatgagggtgaaaaaggtgaagatccatatatttcattgcctaatcaagaggatagtcaagaggagaagcaggagttacaagtttacccatccgataatttagttcttgctgcgagaacagaagatgacgtttcgtatttggatatctacgtttacgatgacggtgctgggttccacagtagcgatattcccgttgaagaaggtgatgaagctgacccagatgttgctcgtggattggttcgtgaccctgcactttacgttcaccatgatttaatgttgcctgcttttccactatgtgttgagtggcttgactacaaggttggatccaattccgaagaagcagccaattatgctgccattggtacgtttgatccacaaattgaaatttggaacttggactgtgttgacaaggcctttcccgatatgattctgggtgaacctcttgataattcaatggtgtctttgaaaagcaaaaagaagaagaagaagtctaagactggacacattactactcatcataccgatgctgttttatccatggcacacaacaaatatttccgttccgttttagcatccacctctgcagatcataccgtaaaactatgggatttgaactcaggtaacgcagcccgctccttagcttccattcattcaaacaaaaatgtttcatcatctgaatggcacatgttgaatggttccattcttttgaccggtggttatgattctcgagtagctttaacagatgttagaatttctgacgaaagtcaaatgagtaaatactggtctgccatggcaggtgaggaaatagaaactgttacatttgccagtgaaaatataatattatgtggtactgattctggtaatgtgtattctttcgatattagaaacaatgaaaaccgtaaaccagtttggacattgaaggcacacgatgctggtatctccacattatgttcaaacaaattcatccctggtatgatgagtacaggggccatgggtgaaaagactgtcaaattatggaaattccccttggatgatgctacgaacactaagggcccaagcatggttctgtctcgtgatttcgatgtcggaaatgtattgacatcgtcattcgctccagacatcgaggtagcgggtaccatggtcattggtggtgtcaataaagttttgaaactatgggacgtttttaccaatagatctgtacgtaagagctttaaaagtgaactagagaatgttcaagcaagagcaaaagaagaagcccaaaaaataggaaaaagttcaagaatcgccagaaaatacaccagtaacgataacccagatactgttataaccattgatgatcaaggtgaagatgaagaagaaagagaaggtggagatgagcatgatgacatggcataatctggatatgaaaaatattaaagcagagtacattgcaagtacaaataaaaaatctatagaagataatactgtatactagtgtaagaggagcctcagaaaaaaacaatataatacattaatatgtgctgttacggtataatttagcatatgatgacaatgtggtgaattacagttgtgtaacttttttatatcacccggcatatatacgctcgtagaatgcgatgtgaaaatttctttttttttttttctaaagtgaaatttttttgagtgatgagatgggaaatgaaaaattttgtgcaattgcgtagtgtctacagttttttaagtagttattaaaagtgttttggaaggtatatttctaggagaagaagcgtgcagaacagtatttagtgaaagatggctcctattgaatacctactgtttgaagaacctactggttacgcagttttcaaggttaagttgcaacaagatgacattggttcaagattaaaagaagttcaagagcaaatcaatgattttggtgcttttacaaagttaatcgaacttgtatctttcgcgccattcaaaggtgctgctgaagcccttgaaaatgctaacgacatatcagaaggtttagtctctgagagtttgaaagctatcttggatttaaacttaccaaaggcttcctcgaaaaagaagaacattactttggctatttccgataaaaacttaggtccttctattaaggaagaatttccatatgttgattgtatttcaaatgaacttgctcaggatttgattcgtggtgtcagattacatggcgaaaaattattcaaaggtctacaatctggtgacttagaaagagcccaattaggtttaggtcacgcttactccagagctaaagtgaagttctctgttcaaaagaacgacaatcacatcattcaagctattgctttattagatcaattagataaagatatcaacacttttgctatgagagttaaagagtggtatggctggcatttccccgaactggctaaattggtaccagacaactacacttttgccaagttggttctttttatcaaggacaaagcttcattaaacgatgactccttacatgatttggctgctcttttgaatgaggattcgggaattgcacaaagagtcattgacaatgcccgtatctccatgggacaagatatatcagaaaccgatatggaaaatgtttgtgttttcgctcagagagtcgcttccttagctgattacagaagacaattatacgattacttatgcgaaaaaatgcacactgttgcaccaaacttatcagaattgattggtgaagtgattggtgctagattaatttctcacgcaggttccctaactaatttatctaagcaagcagcttcaacggttcaaattcttggtgctgaaaaggctttgttcagagctttaaaaactaaaggtaacactccaaaatacggtttgatttaccacagtggttttatttctaaggcctctgccaagaacaagggtcgtatttctagatacttggctaacaaatgttctatggcctctagaattgacaattactctgaggaaccatctaatgtttttggttccgtactaaagaaacaagttgagcaaagattagaattctacaacactggtaagccaactttgaagaatgaattagccattcaagaagccatggaactttataacaaagataaaccagctgcagaagtggaagaaaccaaggaaaaggaatcctcaaagaagagaaaattagaagatgatgatgaagaaaagaaggaaaagaaagagaaaaaatcgaagaaggaaaagaaagaaaagaaggaaaagaaggacaaaaaggaaaagaaagataaaaaggaaaagaaggataaaaagaagaaaagtaaggattaaaaggaacaatgaatcgaaataaagtatatcccatctttttgtgtacttttcttccctttaaagtttttcatatatatatatattatcttttattcccttctaatattcttctttaggatttggaagctgtatattgtatatttagaaatattattaaataaaaaagtcatatgttattttgagcttaagtaccctcttatgcctctttcactcgccattactgacattctgtgatcgccattcatatatataggcctgattgtgcaccaattgccgcgctatcacacctccataagcgatagcattcttcagaatatcttgaaggctcaaaaccaagccattgaccgcacaaatcaactaaagaacccatgtcagacaacgaaagtttctcaaatccattaggcccctcactaggcgctacaagacatttaaatttcagtcccttactgggaccgacaatcaattgtgttagcacacttcctatgaatcccgttataaattctggtggttgtagtgtacattcattttccgtcattaccttcatgctggcgattttatcagaggtgccaattactattatatcaggggagaactgggctaactgtgatatgatagatctacttatcatgttaccaaaaatcggcgatatactaatgaaattctcctccatagaaaataataacgtctttccaaatgaataaatcgggaaagaaaaaccatatactgtttcatcggcggtgtcatttttttgatcaggatcaacctcgtttggaaagttttcgtcgtaattccacgagtgtttacctgaagattggggaagacttggacttttcaccgtcaatgtagttttaatttcaccaatagaggttaattgaagcagatttttggggaataatgggttcattatcttagtagtaatgacggctgtcgaatattgaggaacatccaagtcctgaggaaactcaacttttggaaccgggcagacttctaaagattgcaggttttttgaaatctctgggagatctagcagatgttttggttctggtaagtcattccattgtttaaacttcaaaaagaatcaagtaacataagttagtcaaaccactctactctagcaaaatatgatggggaaaaaagattattgtaacatacaagcatcgctataaatgaaaattttactgtagtgcgatgatatcttggtcgctgtttcttattatttcgcctgttgccacctattgccacgcaacttcttaaattgatttcaatgaagtctgaaattttgatgcgaaagaaaaaaaaaagtaaaggcaataaaacttcatcaagtcaaacgtcatctataaataatcccacttcagaattgaaaaagactacatttgagtggaggaacaaaagcaaaaatgtctgaattaggtgccaaatatcaacagttgcaaaatgagttagaagagtttattgtggccagacaaaaattagagacacaattacaagaaaacaagattgtaaatgaagagtttgaccaattagaagaagatacacctgtgtacaaattgacaggcaatgtccttttaccagttgaacaaagtgaggcacgtaccaacgtggacaaaagattagagttcatcgaaacagaaattacaagatgcgaaaagaacataagggacaagcaggaagaactagaaaagatgagaagcgagctaattaaactgaacaatacagcagcttccactggcccaggaaggtaaaacaaactcacaggtcctcggaaagacaagaaagcgcacagtaccaataaatctgcccaaaataaaattttcttttatatacaattatgtaacttacaaacaaaatacctacgcatttcactgtcctaaacttcaaattgacatgtaagattgcttaacccctaactaattgagatttgattaaatttaccgtagacattaacgtataccaggcaaactcttcagtattgttatagtactcacccaaacgcatgaccctatgtaatttatcctttgcaaaagtaaacgtttctttgtaattgtgggatttatcctgagccataaataactttgaaccaatgtaggtgctcgaaacagccaatctcttagcataccatgcagaatcatggtggtccttttcgttggaaaagtaaatcatatcatcggacaatctgtgtagttcaggaattgcagtttcaaagagaaaggcgcttggaatagccaattgtgacattagttccgacaaatgcccaccgattggcttgtccatctccaatctttttaacagcaaatgttctaatgagggtagtttgtattgtggagttacgtcagggttgattccttcagttaaacgataccttttatctaccaattgaaactttatcagttccatgacagcggtggaagaatggaaaaacgagggcgagttgggagcacctattgaagagatcatggaggaaggatagccgagctcatttaaagattcaacaatggatctttcagagaaaccgtgctcgggaacaaacttttgtagagctagtgacaatactttatactggggtgattcttttccataagttaaaggtttaatatgaattggtttaacatgttcgatagggttcgaatgatataaacgaaagaatttacagcccgttctggcagtattgcgacaaagcatgatttataatgtggtaaagactctgttatctctttccaaattggggtgaagtaccttatgtaggacccaaaaaaaaaaaaccccgtattattgtttcttactattgttattgctatttttcttccgcctaatatagtccgaaaaggaaaggatatgtcatggcaactgtagtcagtatactactgtataggtgaatggattagttaatggactattaggtcaaccattacgaagggggtggggttagtatttttgtatttacagatattgagatatcatacataagaaaaaaattataataacggtagaaaacgcatatatttataagatgaaagttgggcatggcctcccgataatcattgtctcttgattgtatggtaccttttacctctgaacccggcaatatacatgttaaattgataaacttcttgaggattcatgtcatttaattcccacttcgtacttccaaatacgtttctgacgggctccattaagacatccatttccttaccgtatttggatttgacaagatttatgtcgtccgttaggtctttcttattgaaacccgttgtgaagatagcacattttgtttccagtaatgccttcatagtttcacccatccatgaaccgtgagattctggagatgcgtagcctggatggaaagtaaaaaagacatccatgtatggatcgtatgggaaaaaatcttgagcctcatggaatacttcgaaaaagtttgtacgataaatgaatttcagagtctcgtctactctttgtactaccggcgtagtagacttgacgtactcctgtttatcccttttatacaggcattcgggtccaatgaaatgtatttcgaaactctgctctgggaaaagaaactggagctgtttccaaacgtggcccggcaattgagcttcagcacgtgcacctaggatgaaaattctcatagcacggttcttagttgtggttggtaaagatctattctccaacggatataaagtatacctgagagcagccagagattttagaccttctaaggtgataggcccctttgggttcaatgaatacggggaaaatttgtgcagcaaagacccaatcgtaattggatagcttagcatctttgtgactgcggctaattggaactctgtatccatggaatagaatgatcttgtgtagaaaaacaaatcccagtttgttaggttaacggccttgtcgtagccttgctgttggggaaaatcaaactccgggaagggtctaccgcttcttaagtcatgctcataaatattaacttttttcaggatttcatattttttagaatcgtgatatgctttatccatctcccaagcctctcgtgagtgatgagtcggaattcctgacagaggacaagtgtagttaatatctttgccggtaacagggcagtgtgctagcgttctaatcttggcggccctttcacgcaagtccactgagggagactgatcccatggatggaatctgttctccggagtaggatcttctggagagggaggaggatccaatccaagggcgttcctaacgaaccccatgaggtgacgacgtgtttggtgagagacaactagcctgttgtgtggcgacttccttagcagatggaaatatagctgagtagcacccgaaggagcatatagcacggtcatagttctggaagtacaagtttgccaaactactttaagtccaccttcgcaatatctacagtgttctgcgcttataaagtgtaaaaaaactacaaccaaaggcccgcccttagtagttgaccaaatatctactattgtctcttgtcagactcctttggattattttcttcgagccgctttttcgtagcgcatgataaaaagagccctttccccatactgcacacttaagtgaatgccaaatataatatcaagagcgaaaggcggttgagttccagccaagacgagcacacacgacaccagaacgagataaacatgctaggaagggcattgcgacctgggtggctgggcattactaggacggtggttaagaaaccaagttgcgggtcctactttaacagaacctttcaaacagcaattaacactacaatgcctcccatgcaagagggcatgctgagtacaatgatgatgatgacggctacggcaacaaggatcactggcacagtcagtgagccattaaacggttcaaatatagtgatgcaactcgattcagtgatgagaaagaggaaaaaaaagatgaagaaacacaaactgcggaaaagaagaaagagggagaaggcagaaagaagaaagctatctcagggtagataatagggctgtaaaaacctctcacatgtttttctctgctgtttttccttccctattcttcatattttgatattatttcatgtatatattatgtttgtatttagacttttttttttatacgttatactatgctaagaaaactctttaccaagaagtaaagaacccagatcgcgataatagaaagcaccagcagcatgaccgtgtggagtgctcttctagtagcagaatccttgttgaacatccattcttcgtacaagtacgtaatacacttgaagctgaacttgcccattaactcgcgacgattcaactctccaatttctgcaacgatgttgaagttccaatcaaaaatgccttctgcgacgctaatgatctgcaacttttgtgcttcggtcaattccgtcctggtggccagctcatagttcttcttgtattcccatttcaagcgtgtttcttcagtgggacccagatcgctgaaggtgaagaagtttgtgccctttttgaccagttccttctgtgatagcttctcgaagttggggaagagccccagtcttctgtacaaattcgatcgtattagcttgccgccggcgaaaagcgccaagtacagaacgtgacagtaagaaagaatggtgcatggctccttgtgtatgttttcgtggatgttattgataaactgctgtagtagcggtggcttctggaacgtagccaggaattcgtttaatgattctgtgcttttaaacgtgtttgagtatagcagcttcaggtccttatagatctgcgtagatcttctaaaatcttcgagccaaaactgcttcagaatggtcgaagtttgcagctcctcctccgttacggggtcattcagtaggcgatctatctcttgctcgatggcatcgaacacataatagtacgccagaataccctgtctgtatataaagccatgtctcatggcgatggccatctttatgcccatgaaggtattgattttattgtgggcatctctggtttgaaagttgattctgtttgctagcgcccccacgtcagtgggtgagggtatgattgtattgctactgtcctccatttttgcggttattttatgtgtgtgtgtgtatatatgctgtgttatattgtgcactgttaaatagctcctccttagactaagcaagagagtatgaggaggttgctcttatatacaaacacaagagggcgagaggggcacctggccattgctccatcacacccaactcaggtgtaaatcgtcctacttatgaaggtcattagcccatgtttgaaaccgtgtgttacatggctcaaattccacggtccgataacgccgaccccgagcaggtgcaaatggccaggcggtatcgccaatgatccgtttatctaaagatagatagatggccgaacgtggactgcctctatgggtacaataacatatgcacatggcaacgggtcttggtgctcaatcgacgggcacatacaccctgactttccccatcatacgacgatgctctagtaaacttgcacccgcacctgttagataaacaagtgcgcccaagatcacaataccgaaggggcgatatcaccactcagtattctacagtcgagcatagcgtagtctggcagtatcccgcacgatccattgtattgtttgtccaaaccgcattttatgtgtaacgattaatcgtatatacatggcctacaagaaattaccctgcggcgaagggtgaaaaaaaaagtagtggaaactaaagaaagaagagtttagttacggaccctttcaaggattgacacactcccaatattttgctacattattgacctttgttgaaggaggcgttcgtttatttaattattttgttctgttttgcctacaactgcgaatacgctcacattctagtttgaccttcacaaattcttatcatcttcttttgtttattttgacacacccctattaagtgtatttgttttgtaagtaatgtctaagcagtttgttcgttctgcaaagaacatgatgaagggctactcatccacacaagtgcttgtgagagatgccacggcgaacgactcgaggactccatcgatagacactctcgacgatttggcacagagatcttacgattcggtggacttcttcgagattatggatatgttagacaagaggctgaacgataagggcaaatactggagacacgttgccaaatcgctgaccgttttggactatcttgttcgtttcgggagtgagaactgtgtgctatggtgcagagagaatttttacgtaattaagacattaagggaattcagacacgaaaatgagtccggatttgacgagggacaaattatcagagtaaaggctaaagaactcgtctctttgttgaatgatgaagaaaggctacgcgaagagaggtctatgaatacaagaaacagaagggcgaacagagctgctaggccaaggccaagaagacaaagaacaaggagcaacccacacgattcttctccctcttaccaggacgatttggaaaaggccctagaggagagcagaattactgctcaagaagatgaacaacgtagaagagaactggcccagtacgacgatgaagatcctgacttccaagctgccttacaactaagtaaagaagaagaggagttgaagcaattgcaggaactacagagattacagaagcaacaacagtctctgtctcaatttcaagctcctttacaacaacaacaaccacaacaacaaccagcgtactacgacattttcggtaatccaatctcccaagatgaatacttacagtatcagtaccaacaggaccaggaacaagcaatggctcagcaaagatggctggaccagcagcaagaacaacagcagcttgctgaacaacaatattttcagcagcaacaacaagctgcggccgccgcttctgccttgcaacagcaacaaacagccgctaatatgcaacaacaacaacaacagcccgctgattttcaacaacctttgcctacaggttctaataatccgttttccatggataatcttgaaagacaaaagcaggagcaacagcatgctcaattgcaaagacaacaagaagaagctagacaacaacaagaacaattgaagctacaacaattgcaaagacaacaacaagaggaagctcaattacaccagaagaggcaagaagaagcccaattacaacagcagcaagcccaattgctacaacagcaagcccagttccagcaacaacaacccttgaagcaaacaaggactgggaaccagtctatatcggataaatacagcgacttgaataccttgttagcaactggtacagggatagatacttttggtaacactggagaggcacgtattcctgcacaacatacaaagacaggcacatttataaattctcagggtacaggctacaaacaggttactaatgaacccaagaacaaccctttcttaagcaaccaatacactggtttaccaagcacaaatatcgtgcccacgcaaacagggtacgggtttggtaaccaacctcaaagtcctcctactaattctcctcagcaaaatcctactggtataagctactctcagccacaacagcaacaacagccacagcaacaaccgcaatacatgcaaaatttccaacaacagcaacctcaatacgcccaaaacttccaacaacaaccacaatacactcaaaattatcaacaacaaccacaatacattcaacctcatcaacaacaacagcagcagcagcagcagcaacagcagcaacagggatatactcctgaccaaggtgtaagcttaattgatctttgatactgtcctatatatacttttttgtcatgggtacacatacatgtacgacatatatatatatatatatatatatattagcgagtttacattgatgtagagcagtaactggaagaaataaaaatttaaacttaatactagggggtccgtcttctcgtgggtacttcttttacagttttcaacttctgctgacttgtatgccttcttggcgcttcttcggaaaagttgacagcgggctttactttaacggcaaatcgcagtaagtaagcaagtaacgaactcgcacttcagcaaaataaaaaagaacaatcgattagaaattcaaatttcaccgtgactctttaacccctgccgaatattataagcaaactatgataacactcttattatacctgtgcgtaatatgtaacgcaatagtgttaataagggctgattcgatagcggacccttggcctgaagcgcgacatctactaaataccatagctaagtccagagacccaatgaaagaagctgctatggaacccaatgcagatgaatttgttggattctatgtaccgatggattattccccacgtaatgaggaaaaaaactaccagagcatttggcaaaacgaaatcacagattctcaacgtcatatttatgaattacttgtacaatcaagtgaacaattcaacaactcagaagcaacatatacacttagccagattcacctttggagtcaatataatttcccgcataatatgactttggcacacaaatacttagaaaaattcaatgatctaacccacttcaccaatcattcggccatcttcgacttagctgtgatgtatgccactgggggatgtgcttctggtaatgatcaaaccgtgatccctcaggattctgctaaagcactgctatattaccaaagggctgcccaactagggaatttaaaggctaagcaagtgctagcttataaatactattctggcttcaatgtcccacgaaattttcataaatctttagtattgtacagggacattgctgaacagctgagaaagtcgtactccagggacgaatgggatattgtcttcccctattgggaaagttacaacgtgagaatatcggattttgagagtggcctattaggtaaaggtttgaattccgttccatcttctacagtaaggaaaagaactacgagaccagatattggttcaccctttattgcgcaagttaacggtgtacagatgaccttgcaaatcgaaccgatgggtaggttcgctttcaacggtaacgatggcaacataaatggcgacgaagatgacgaggatgccagtgaaagacgaatcattcggatatattatgcagctttgaatgattataaaggaacatattcacaaagcagaaattgtgagcgcgccaaaaacttgttggaattaacgtacaaggaatttcagcctcatgtcgacaatttggatcctttgcaagtattttactacgtccgttgcttacaattattggggcacatgtatttcaccggcgaaggctcctcgaagcctaatattcatatggccgaagagatcctgaccacgtcgctagaaataagcagaagggcacagggacctataggtagagcgtgcatagatctgggcttaataaatcaatacatcacaaacaatatttctcaagcaatttcgtattatatgaaagctatgaaaacacaagctaacaatggaatcgtagaattccaattatccaaattggccacttcattccctgaagaaaaaatcggcgacccatttaacttaatggaaactgcctacttgaatggattcattccagccatatatgagtttgcagtaatgatcgaatctggaatgaacagtaagagtagtgtggaaaacactgcttacctgttcaaaacattcgttgacaaaaacgaagctattatggcacctaaactgaggacagcatttgccgcattaatcaacgatcgttcagaagtggctttatgggcttattcccaactagccgagcaaggctacgagactgctcaagtctctgccgcctacttaatgtaccagttgccatatgagtttgaggatcctccaagaaccacagatcagagaaaaactttggcaatttcctactatacaagagcgtttaaacagggaaatatagatgctggtgttgtcgcgggagatatctattttcagatgcagaattacagtaaagctatggctctttatcagggtgcagctttgaagtactctatacaggctatctggaacttagggtacatgcatgagcatgggctaggtgtaaacagagatttccatcttgctaaacgttactacgaccaagtttcagaacacgatcatagattttacttggcttccaaattgagtgttttaaaattacacctaaagtcatggttgacttggatcaccagagaaaaagtaaactactggaaaccttcctcgccacttaaccctaacgaagatactcagcactcgaagacttcatggtacaagcaattgacgaagattctacaaagaatgagacataaggaggatagtgacaaagctgcggaagattctcacaaacacagaactgtagtgcagaatggagctaaccataggggtgacgaccaagaggaggcttccgagattttgggcttccaaatggaggatcttgttacgatgggatgtatcttggggatattcctattaagtatattaatgagtacactggcggcccgtagaggctggaatgtccgtttcaatggagcacaattaaatgcaaatggtaaccggcagcaagagcaacaacaacaacaacaagcacaaggtcccccgggctgggacttcaatgttcagatattcgccatatgatgtggtttgtatagatatatacatagactatccatagaaatcacccacgcattacccgaaagttttcaataaagcgaacagcgagaagaaaaaaagcgaaaccgacagagaattaccaccctagagctttaaccccattgagatcaacacaatttcgaacagtgaaagtgcattggcgaaggtgatacaattggcttccagctctgaataataataacttacaagcgcaaagataacagataattttatatcagcatacaaatggtcgtcatagctaatgcgcacaacgaattaatccatgacgctgttctagactattatgggaagcgccttgcaacctgctcttctgacaagacaatcaagatctttgaagtcgaaggagaaacacacaagttaatagacacgttgactggccacgaaggcccagtttggcgtgttgattgggcacatcctaaattcggaaccattttggcatcgtgttcttatgatggtaaagtgttgatttggaaggaagaaaacggtagatggtctcaaattgccgttcatgctgtccactctgcttctgtcaactctgttcaatgggctcctcatgaatatggccccctactgctggttgcttcctctgatggtaaggtctccgtagtagagttcaaagaaaacggtactacttccccaataatcatcgatgctcatgccattggcgttaactctgcttcttgggctccagctaccatcgaagaagatggtgaacacaacggtactaaagaatctcgcaagtttgttactgggggtgctgacaatttggtaaagatttggaagtacaattcagatgcccaaacttatgttctggaaagcaccttagaaggtcacagcgattgggttagagacgtagcatggtcacctactgttcttctacgttcttatttggccagtgtttctcaagatcgcacctgtattatttggactcaagacaatgaacaaggcccatggaaaaaaactttattaaaagaagaaaaattcccagatgttttatggagagccagttggtctttgtcaggtaatgtactagctctttccggtggcgataataaagttactttatggaaggaaaatcttgagggtaaatgggaacccgctggtgaagttcatcagtgaagagtatcaagaatttaaaatgaaacatctcaaaagaaaaaagaatgcaaatgagtctatcgacgaatttgaagggaaataaacgcataatgtacagtaacgtataacaattaaagatttgtggaagttttcaaaaacttttcaacttttttctttgttttttttttgcaacttcttatattaatattgtcatagatatttcttatacaaaaacaagcgaacaaaaataatcgacgtatatacaatagatatataagactgtttttcttcaatagaacaggcgaaattattctaccggccgaaggtacatcttcccgctatgtaataaatagaggtatttaagttataacaattataattcccccattacggcagcaattaagttttgcacgtcattagaggcgattttaccattctccagtacttcagcgtgagtcgctttgcctttttctaagggtacaggtgattcgtccaacgcactggcagggctatccaccacgcaagtattggtaatcaaacttaaggccaaaaccctccatccgcaatgtcttgcaacaatgacttcgggaacagtactcattccgacagcatctcctcccaacatccttatcattttggattctgctcttgtttcgaaagtgggtccagatacaaaagtataagtaccttcatgcagtggcctttgaatcttgagctctttccatttcttaaataaaagcttcctcaactccagatcatatgcatcactcaaggctaaaaaacgaggtccatcttcatccaagttaggacctctcaatgggtgctggccagcaaggccagggatatttaaatgatcataaatgcacatcaaatcgcaggcttgatatttcgcgtttataccaccagcggcattagtgacaattaaattacgaacatgacccatgtggttaagcactctaataggaaaagtagtctcaaacaatgtgttgccttcatatccatgaagacgaccattcattaatactactggtgaaccattcatagatccgaacattagtgtaccggaatgacctggaaccgtacttttcttgaatcctgggatgtcttggtatgggactgttaccgggggtggattgtctctagacagcttggtagatattccaccaagccctgaaccacatataatcaaagttctcggaggctcgaaatttgttgtatttttgaaatgtggttctaaaatagcagaaatatacgcagcggccttggtaattgcttcacgttgttgacttacgttcaagatatcactcatcttttaagtttattcggagtttctcatgtgttctagaagattagcaagattatcctaaagttatgcctgccctatctgccctctgcttcgagattttccttttctttgcgctttgtaaacactgaaacaaaaacaaaaacaatggaaacatcagaaagatatttatttattgtggccgcataaagttttaattctttgataattaacgtcgtatttgggaaactgcttactataccggatactaggctgccctgatcaaacaaggaaattgacagatgatgcttgaagggtatacggtacaacctccacagtctactttgataggtgacattgaaattcaggacgaaaatgcaaaccaagaagttaagaacgtactttaccaaggagttcaaaagggtataaaaaggctagaaaaaagacaaaggagggttgcattaggtgatgtaacctctcaaaaggcaaacaaaatacacaatgctatacataataaattccatcagacgaagaacaattttgaaatagagaacatacgctcatcggccttggtaaaagaacaacaacgagacgtaaggcatgaagatagcgactattttttaattgatagttctgaaggctcttctactgatgacgaacaagttaatgaagatgctattgatgatttgttaagtcgaagagtaaatgatcagcagattcaagccgatgaagtgtatgaagatttcgatggagaaatgcaagatgtcattgaagaggatgttgatagtcaaattgaaccactatcaccaataaacaacgatgaaattcagactgagctggacagggcgtttgaaaaatattttcggtcggttcccaatccgctggatgatgatacccatgatgttgtgatggttgtggagtacgcttccgacatattctattacttgagagaacttgaagtgaaatataggcctaatccctactatatgcaaaatcaagtagagcttacatggccgttcagacgaactatgatagattggctagttcaactgcattttagatttcaacttttaccagaaacgctatacctgacgattaatatagtggatagatttctgtcaaagaagaccgttactttgaacaggtttcaattggttggtgtatcggctttatttattgctgccaagtttgaagagattaactgccccactttggatgatctagtttacatgctggaaaatacatacactagagatgacattattagagcggaacagtatatgatagatactctggaatttgaaataggttggccaggacccatgccatttttaagaaggataagtaaagcagatgactatgacttcgaaccaagaacattagcaaagtacttattggaaactacaatagtagaacccaaactagtggctgcggcaccaagctggttagctgctggcgcgtattttctgagcagaacaattcttggttcaaatgattggtctttaaaacatgtattctactctggctatacatccagccaaataattcctttagcatcactgatattggagaattgcaagaacgcatctcgacgccatcattcaatttggaaaaaatactttgaccaaaagcattaccgctgttctcaaattgtagaagaatggattgtttcgacagaagcctaacttactcatcttaacaccatttgcttcagttttggtttcggaaggatcatatttcatttattcaggtagaagatatatatcatattacacacacacacacacacacacatacacatatacacacatatatatatatatagatatatatatgaatgcatccttgattccgtttcagttaacaccccgatggtccacccaagtttatatcatcctctttttgaccgaatctttatttgacaatcttcaagcagcctcagggcaaaattcaattctggagggtttgatatatgtgccctatgcctccaggtaagcggcattcgcagtagaagagcagcaatcacatactccaactaagttaaaagacgatacttcgtatcttaaaaagaaattaccttattcgtctagtttttttgcttatcccttctttgcttcgcactttctactaagctgtcccagcgttctcttaatcgcccaatttcattagccaattttttattttctttcgtaatttcgtcaattttcataccatattctttaaattttttctgctcatataataccaactcctttttgaattgttccagtcttaagttaatcttcatttccgagtttttggaattttttcctccttctgttttcaattgaatatcattattcaaattaaattgtaagcggttcaaaattgacataagaagtggatcgtttatgggacttaatgtgtcctgatatgctgggttatcccaattcctagcattgcttattccatttatcggagatttgttgtttaaaataacagagccaataagcatattgttgttgaccattccaatattattttcttctgatgactgcttttcaatcaaaagttccaattcttggattttggctgtaatgtcctgttttaataggtcaatggcttgcgtaacgtcagaacttaatttattttgagacaaattctcgttctgcggacctaaaacttcaatggcttcttgatacttcgcttttgcatttgtaaaatctccttttcgacattcctgttcggcgtcctcaataatagtataaacctaattcatgttagtcaccatgaacaaaaaaaaagtgggggcataattcaaaaacttacttccgctaaagtactcattccatcaccaagattagtataactgtcgttgaattatcgaactaatccgtgcagcgatacagatgttttttatttcaaacagagcgttccattacgctgagttgaatcatctggtttttctaccctttaggaaattctaaagttgaagaggcgctatcgatgtatgcaatgatgaaaaagtggtacagagctttatacatattacaatacagtgcagaatttataaagggagataatacatttgaagcggttgttggtatagatatattgagagtactataataaaactattgggcggtggtaaaattcctgaacaaggaaggcatcattatactaatttatgatcaccgtcggcatccaggtcctcttccaactcgccaaccatattttcatcatcgacaagtacatcgtccaagtacgaatcttgttctgcagctacataatcctccatcaggctttgtactacttctcttgactcggcgaattcatcttgaacgttctgcattgattggaacaagtcgcctacattataattatttaaaaatgcgcccttggcaaatactttgtcaaaagtattgcacgcattctcaaagacgttcaccacggtagacatattgcttaacatcatgccgctaacttcattttcatttggctgtaaaggcaggtatggcgatcttcttccaatgttaacgtgcatcgcagaagaggaccatgaggggaatttgatgcgttgttgtaatttggtcatagcacgcgatatctgacgaggttctacattaccaatgattgtattataaacgttaaaatatgttggattgttcatcgcggtagagacaagagaattggaagggtctaataaatctaacatgacgtcataactggaatggcctttatgcgctatatcatcgtgaatataatctgatgtaaatggagtgaaactagggcttaggaaatgaagttcaggggaaggaattaaggtagagtaaatactggacatggatgaatacatgtaactcggaaaccgtatactgttcgttactgaagatattatggtcgatatcaattgattcgtgtgttgtaaatcgatgttcgggtttctaaacactttaccggaaatattcagcaacgaagcgttatcaaacaccaccgttgcatcgctatcttctatcagtcttctcaaagccagaatagtgttataagattgaacaacaacctcagaagatcttgcagggaacacagaatatgtcgtgagtatttttttaggatatcgatcacacagcgcttctaagaggttggatccgagccctgaaccggtccctccggctactgagtgcagcaactggaaaccttcgaaattgtcggtagaatcaatctccttgtcgatcttgttaagaatatcatcctggttacgagttcctatatcatacccattggcccaagaattaccagcgctagcgccatcagaagctacccaggtatttctcgggtcaaaaaacccacgaaatgtgttctccacgtcggcgatgacactaggctcggaatccatcataatagcccttggcgtaaacttattcctactgttttcgcggaagaaaggctttgtgtcatcatctctttccgtactggaatcaggaagctgagatagcccatcggtgcctatagcgtgttctttcgccaattgagaccagagaaacttaccaacgtggttcccgcattgacctgcttgcaaagtaataatttctccacccatagatagttatatgttgaattcttatgcatgtgactaaccgatattacgcatttgttcatttcgcagctactgttaacgattattattacatttaatgaaatttcccaaaagataatattaacgcgttctgttacccggtgatattttttgaatgtcagggtaacaaagagagaacgttataatgggagaatagtaaatatttgctttaggaaattagtaataattgcaatacggaaaataggtgcattttgtgtttcttgaaaggtttgaactaaagaatgtatacatatatattagagcgtgccttcatgcagggaattagaggatccgctacggaagagagaacttcgtaagacattattgctgtgactattttgaccgtttccaagaactcaaccagtcatttatctttggagtaacaaagcagtcccatttgagagacccctcatcatgatgattcagtctgtcttgcctgttatacgaaacgactactcttgacaaatctttttgggaaaaggttggtgcctttttctttgcctttatacaaaactgcacttgttctgtgaatttattttggtacggcgttacggtgatttgctcaacatgcgccgtaaattggcccttttcgataatatcgggtgaattttcccaatctatgaggccacctgcccagtttattgtaccgggtccgttggtttccgagccgcctggccaaacagcgatttctagtctcatcggcgtttgtgggtacctatattctttactaatggggtcccaggtatccttcttcaggactgtgcgagctattttaccatcaacataccatattatcctatccgggtcccaatcaatctcataagtgtggtaagtggcccaagtgtcagcgcctacgggaaatctttgcattcttgtgtaatccaaatgcccttgagaatagtagtttgattgggccgtcattaaatcaccacccagccactcaaaatcaatctcgtccccaattgcggatgttaagtcaaatgcagtcaccacacccctcgacctcgccgttttcattcgcacgcttgccttgccgtatagaaatgacctggtcgatgtgatcaaacttccggtagttttttttggcatagccagaacaatattcccgctactcgcttcaattgatgtgtagccgctatgtgtgaaatcgaaatcttccaacattttctctgcctctttactgtctggagtgaccaagaatttggcgtagtgtatgattctcttggaatttagctccccttctactacacccaccttggtatttgccttattcggtccatttccctctcttattggtggcttaggttgatagttcacaataaatttaggaacctttggtgtgctaacaaattcaagtttttgactggcgactaatgcaggtataggagcacagctttcctcgtcgaaagatgacctcacgttgcagccaccgacacatatcggtccagcgccacattcattatacggcgagcagcacggccattctgcgggacaagggttatttggagaacaagaaatggagtttttgggtttgtataattctcccagtgcaaatccgatgtagccaacaaccggcaccagctgtaatattgatattctcatatttttatttcgtgcaaaagcccttgatgatactctaaactaaacgactgttcttgtatttcgttattaatcgataattattagctggtattgtcttttttttttttcctacatgatcgtcgcgaggctttacataatttttgtgacgcctttaaaagtatagtagaacgagcacataagaagtaaatgaaaagtacggcagatgcaattgacagtaaagagcggtacaatagttgaagaatacccgataaaaatgtatttaggttgcttgacgggtttgcagcaattgccaagaacactaactgtggcaatcttggtgagaatctactcccaacccaaacattttcgccgatatttttgctcaccttttttttttgctcatcgaaaattgttatagcggctcgactttgatttactaatacacccaatttctaatatcctcaaggctagatcgttctctcaaggaacttaaagtgcctgatcttgcgatgattaatctacagcgatggatacttaaatcatgtaaaaatctcagttttgaagtcgtttgctctcttccatgcttcagttcccttttggaaggtaatataatcatctaatttctcgcatattcacgccgacggaagaacgagccggatcaatatggttagaacccgtgtattattctgcttatttatatctttttttgctacggttcaatcgagtgctacacttattagcacttcatgtatttcccaagctgcgctataccaatttggatgttctagtaaatctaaaagttgctactgtaaaaacatcaattggctgggttcagtgacagcatgtgcctatgagaattccaaatctaacaaaacactagacagcgccttaatgaagttagcatcccaatgttcaagcatcaaagtttatactttagaggacatgaagaatatttatttaaatgcgtcaaattatttgagagcacctgagaaaagtgataaaaaaaccgtggttagtcaaccgctcatggcgaacgagacagcgtatcattattattatgaggaaaattatggtatccatcttaacctaatgcgctctcaatggtgcgcttggggtctcgtcttcttctgggtggctgtgcttactgcagccactatcttgaacattctgaaaagggtgtttggtaagaacatcatggcaaactccgtcaaaaaatcacttatttatccttctgtttacaaagattataatgaacgaactttttatttatggaagcgtctaccatttaattttacaactcgaggcaagggtctcgtcgtattaatttttgttattttgactatattatctctcagttttggtcataatattaaacttccacacccatatgataggcccagatggagaagaagtatggcctttgtgagtcgtagagcagacttgatggccattgcacttttcccagtagtctatctattcggaataagaaataatcccttcatccctataacagggctttccttttctacatttaatttctatcataaatggtctgcctacgtttgtttcatgttggccgttgtacactcaattgtcatgaccgcctcgggagtgaaaagaggtgtgtttcaaagtctggttaggaaattttactttaggtggggtatagtggcaacgatattaatgtctattattattttccaaagtgaaaaagtatttagaaatagagggtatgagatattccttcttattcataaagcgatgaatattatgttcattattgccatgtactaccattgtcacaccctgggctggatgggttggatttggtcaatggctggtattttatgctttgatagattctgcaggattgttagaataatcatgaatggtggcttgaaaactgctactttgagtaccactgatgattctaatgttattaaaatttcagtaaaaaaaccaaagtttttcaagtaccaagtaggagctttcgcatacatgtatttcttatcaccaaaaagtgcatggttctatagtttccaatcacatccatttacagtattatcggaacgacaccgtgatccaaacaatccagatcaattgacgatgtacgtaaaggcaaataaaggtatcactcgagttttgttatcgaaagttctaagtgctccaaatcatactgttgattgtaaaatattccttgaaggcccatatggtgtaacggttccacatatcgctaagctaaaaagaaatctggtaggtgtagccgctggtttgggtgttgcggctatttatccgcactttgtcgaatgtttacggttaccatctactgatcaacttcagcataaattttactggattgttaatgacctatcccatttgaaatggtttgaaaatgaattgcaatggttaaaggagaaaagttgtgaagtctcagtcatatatactggttccagtgttgaggacacaaattcagatgagagtacaaaaggttttgatgataaagaagaaagcgaaatcactgttgaatgtctcaataaaagacctgatttgaaagaactagtgcgctcggaaataaaactctcagaactagagaataataatattaccttttattcctgcgggccagcaacgtttaacgacgattttagaaatgcagtggtccaaggtatagactcttccttgaagattgacgttgaactagaagaagaaagttttacatggtaaggccccttgttaataattcttgcacgcatacttttgttattttgttgctttatcggataaaagttaatataaatcgatgtaaataattttatataatcatacaacagggtaataaaaagacgaatatattcaaatgcgggttctaaatctaagtttcattctcactatcactgctttcttcctttgcctgttgagagagtagttctttccatttttgagtgagctctcggattgcttcaggatttaaactagcttctacgagatcctgtggaacatgattttcggagtgctcttttgaagcgaatctccccgtgttatgcctcgtcactaaccttaattcataatcttcaacatcattcttcggaggtgctatcgcagcaatctcgttccatgaaaatagcaaagaatctgtcttcctggcaaacggatttatatcaacaatgaagattttattgaaaggtcttggaatataaacgtcaagaacgaaacttttatcaggaaacttgggcaggacgacatcatgaactatttcatcaataaggtccttgaaggtatctgacaactcatctaaatagtcataataatttaaatcacgctgggtggccccaacgatatgcgcattcttaacgaagaccctaaattcgagtgccggattcatatcacaccattgtctaagtaccaagtcaaatttcaatccttttatatcatccccgtccacgcagcctttaaatgctctttgaaggtcatgcattatgtaattggatgcgttcaacaataggtaaagctcatttacctcgttacacttcatagtgttattcggcaaaatccaggtagcgtctcttggtgcagaccagtttaacttgggagccactgcacctaattcgttcaaagcatcctttaatttctggtgtaattctggaaaatctatcaatggctcaacttcttggacaaattcggtggcggtatcctcatcgtcctcccaatcactatagtcattatcttcatttcttattatttcctcggtgtacacagacctggagttttcctcttggggtagcttgataccgtcttgttccaaatattgaataaattttttcggtaaggattttaacactatggattttggcacatatttgggatacagtgaggaccaaaacgagtaagaacagtgttcaacctgcgctcttgtcactggtatatctataaaagttgtatattcttgtgaggacatcaataagtaatttatgtcagcgctttttggacgcacgttttagtttcactggtggagttacggtatcattagcttcttaatcttcccactgcataaatggacatcggaaaatatccgcttattatgcctgaaaaaataatttttttaacagagttttctacgtactttttacttaactactgaggcagcgcaactgtttagtatttaaacatataagcatatatataatgcaagtaatcaggagaacatcttcgaaagagactttttagctttttcgttttgttgctttctttttaatttagtattatgaatagctnnnnnnnnnnnnnnnnnnnnnnnnnnnnnnnnnnnnnnnnnnnnnnnnnnnnnnnnnnttttaatttagtattatgaatagctttcaaaatggcagcgtcatttggctggaaagtagtggccatttctaggtcattgagagccatatctgtgtcattaacatggtaataggccaggccacgacggtacaaagctttggccttggctttttcgtcagccgcttcggcatataacacctccgatgaggctactaatacttgcttgtaatcttttaatttaagagcacagatggcaatattcaatggaatagacactttcaattgattgattttttcaatttgttccttctccaaatcttctgggaaatactctttcaagaatttatcacatttgacatatttttctaaagccacggaatagttctgtttcttgaactgttcagtaccaatgttctttaccgtttcgatagctttcaagacggtgtcgaaattcttcaagtcaactttttcgtcttgttttaaaacatcttcataattatcgccgtactcatctgttggtgtagcttcggcattctctggcacttgataatcgtcaggtaacacgccacagtcatcaatctttacatcacgcaatggcttgttgttttcttggtcacattgttggttttcaatcaaacgaacaattcttttaccttgaatcacttcaccaaacacaacgtgcttcccgtccaaatgaggtgtaggaacacaggttatgaaagcttgagatccattggtatttggaccggcgttggccatggatagaaggaatggtttatcatgtttaacagtgaaattttcatcctcgaatttttcatcgtatatgctctcaccgccagtaccattaaaattggtaaaatcaccaaattgacacatgaagtctttgatcactctgtggaaaatggaacccttgtacgacaatggtacatcaggtttagtctttgccataccagcatttccttcacacaacttcaaaaaattttcagccgttttaggcactatgtcattgtacaactcaaaaactatacggccttggggtttacctccaatagaaatatcaaaaaaagttttaggtctagtcatttttactccttgatcgcctgaatattgtcttaccagttttctatgtgatgtgagcgcatcagcacctctgatattcgacttatttaaataattttctgtctgaactttctccagctagggcggaaaaatattctagaagctcatagaaatgccgttcaaaagcgtaacagttatgttctataaagggaaacaatgtgtttcgatcactgcagctgtctattatatacaagttatacatcacgacatttagattttcatttcttcttttccgaatccttactggtcgtcccatccacgtccactgtgcttacgcgctctctattaccattcttttcccaacacttcctaaataacgccatctcgttgaagcactgcctccagtcacctgtttcggcatggcacagctgtaatgcgaggttctctacgtagcatccggtcttggatattctcgtgtcccacacatccgggtcttcgtcttcttggacctctttgtattcttccagcgcctgcttataatactctgaagtttcgccagtttcactcatgaccagtctgccagttttagcctgccagagcttttctttccctttaatcttcccttgtttggcgcaactcttagaagtgcctttcactacctttaatggctgaggcccctttttttgtttcggacatttgttgtgagaaaaaaaagaagaaaataaaagcataaatgaagcgaatggatgagaagaggggagggaaagcaagaacgagaaggacaaacatcagggacccatacttcaataaattgcttgatttggtgttaatcaattcttctaacatcaaacctcttttagtttccttcgatcgtttcacgttgcttatattgattgctttttacttctattttttcactagaataaacaaacaaagacattctgttgatcaagaaagttgaaaatggtatttggttttacaaagagggacaggagggtacctgatttatctaggtatgattactactatcagaaccatgaagattataacaaaagtcctcagctctctgctgctgctgcctctgctgcttctgccgcatcaccggatcgaaccaattactcaaggtcgcactcgctggttagtcatgcaccttcaataccgagacaaagaagttcggtaaagagcccaggaagaaggctttccacatcctctgccgctccgccaacgtccagggcagcagctaagcagtattcacagaagacttactcgttgaggtcgcaaaggagcggagagtaccatttacacccgcccggttatactactaatgggagccgtatgaattctatgacgtctggtgcgaatgtcagaagaaactacggtaagaacaaatcgacggccggcaacaataacgattcaagggccaactccattaccgtaaagactacacaagtaacagacccttcaggaaggactcaatcaattaccaaaaagacaataagaaaaataaatgggtatgaatacgtagaaaccacgactacgactaagaatttggttccattaggtgactcgcagcgtcatttcgatgaatttagtgaaaattacatgttgcaagatgacgacattttagaggaacaagctagtgataacattcacgatataatcgaggaaaacgaaacagataacgaaaagccatattccccagtaagcgaaagtcatttacaagatgattcagagctaaacgtggaaaaaccagatttcccacttggatcatatttccaccataagtattctacagacgttatgcctctagaagaagaaagtagtttatcaaacttcagtgacgcattagattatattcctcccacccatcagaccagtagtaaatatattcataataaaaggaagcaagcatcgacgacaagaaggaagaaaagaccgcctgccgtgaaaaacgcagaagcagaggccaagaaaccattaaccgaagcagaaatgtatctgaaggcactagaggttgctaaaagaaacgtttatcacacggatgctgcttcggataacgcatcggcccccctcgggagtaacaaatccaggaaaagtaggatgggtcaaaaaatgaccttgagaagcagtagtgattctccgacggcgactgctaatcttgtcaaatctaatgtcgaggttcaaccaaaaagatttacaagttccttcttcagcagaaatactaaaagcgccccccatgaagtgcacaatcactctgtgtctacacattttaaatcgaataaggctgttgacccagttccagagcctaaaagtgcaaacacagggctaacagataaagaaatgtatgaccaagctttgaaaatcgcacaagcgaggtattacaactcacatggtattcaacctgaagcagtcgataatagcactacggcggctaaacctcgtcaggtcggcgttagccatctgggatccactgggagcatcccgcccaatgagcagcactatttaggggattctgaaattccagtccaaagcgaagtgcatgaatacgagcccattccattgcagaagacaaaaacaactggttcttccaaaaataagttcaaaaccatgttcgataaagtgctgcaattctctcaagaaaactacggctaccagcacaagaaggaacaaggcgaacaaactccagttactcgtaatgctgaagaaagcttcccagcagcgtctatttcggaaggtgtgacaaccgcaaagccatcttcaaacgaaggtgtgatgacgaatccagtagttacagattcaccttcaccccttcaacaacaaatagactcgactactgcgtcctcgaatgggcaaagtcagggcaatgtacctacctccgcagtagcttcaacaacgagaacaagatcaccggaactgcaggataatctaaagtcttcttcttcgcttttacaggaccaaacccctcagcgtcaggaagacgccacggatccaacaacatcatcgacgaatgaattatctgccgctgagccaacaatggtcacttcgacacatgccactaagacaatacaggctcaaacacaagatcctcccacgaagcacaagaagtccagtttcttcactaaactgttcaagaaaaaaagcagccgttagcagttgtttactcgaattttgcaatcaaccctaatttttgaagcctggttttagatttattctcttctttttcttcttgtgaacttcaattactaatgtaacttaatttttaatataacttttacagtttaataatattgatttttttcggtctggaccaatcgcgccgcatttctcactaatattactaacataccctcttctcattggctcggtacccctttcgtgacccgcattttttgttttctttgttagcccgaatgtctcacaatgaagatgtaaaattaagattatatatgaaaaattgatacaaaacaaaatagttcaaataatcaagttaaagcgacatcactctcaatttttgctttttttaggtttatagaatagaaatataacagaacgaagcctttagactctttttttttattggtatattgaacaaagaaactttttttttgtcctcccatatctcgtgcacacaaatattatgtccattgtagcactaaagaacgcagtggtgacccttatacagaaagcgaaagatagtggtggaacctcagagttgggggggtctgaatcaactcccttgttgaggggtagtaatagcaatagttcaaggcatgataacttatcctcatctagctcggatattatctatggtagaaattcagcgcaggatctagaaaactcaccgatgtcagtagggaaagataataggaatggcgataacggttcagataacgaaaaggcgaacctagggttcttccaatcagtagatcctcgcgtaattagcgatttgattatcgggctaagcgacggtttaaccgtcccctttgctctaacagctggtctatcttcacttggtgatgcgaaattggtcattaccggtggctttgctgagttgatctcaggtgcgatttctatgggccttggtggctatttgggagcgaagagtgaatctgattattatcatgctgaagtaaagaaggagaaaaggaaattttacgataactccaacctaattaacagagaaattgaagacattctgttagagattaaccctaatttctcggacgaaacaatcgtttcgttcatcaaagatttacaaagaacacctgagctaatggttgacttcattatcaggtacggtaggggtctagacgaacctgccgagaatagagaactaatcagtgcagttactatcggtggcggttatctacttggtgggctagtaccactagtgccatatttttttgtctcagatgtggggacaggtctcatttattctataatagtcatggttgtaacattattctggtttggttacgtaaagacaaaactatccatgggtagtggcagttcgacttcaaagaaagttacggaaggtgttgaaatggttgttgtgggtggtgtagcagcaggtgcggcttggttctttgttaagttactgggttaagtgtaaagtaacaacactatacatatttattgtaaagaaatttgggattgagaagctttgctatatacttggaactgggctggattttctcgacatacatttcttttacgttttaatttgtttctatattctcctctttaaatttatttatattaatgaatttcaaactagtttctttttctattgccaagaggcccatcaggtgatccatgataacctttattcgcattgaatcgtttttcattggatctaattcgtcatttggtcgccgcctttctttgctccttctgcttttttctttttctctttgactatcaggtcataagatcttctcctccattatgcccaagtgtttttcttttttttgcctttatataaattacaaaatacatacatatacttctcgtgcagtatactggaatcagctttataccatatgaagcacaacttggatcaggaccgctcttcattaaaaatcgaagaattatctaaataattaatgtgcacgtcaatatattctccgcggaaacatgacaaacttttagaaaaagatttaaagcaatatttttcagttctccatttctttatttttcaagaccaattctagttcaccaatatcaaacattcctatgccttcttgcagagcatctgccaaaatggatagtgatttattcgtgaaatccggggcagctctaagacgattgatatcatcaccgtagttttcaaaaagtaaatttaagtattcttcccttaactttgtcttgtctttccctttgggcacaaagttttctgccaattcattgtattcttctctcgcaagcttgatattttcggcaattttcgatgcattcataaaaccctccttgttttgagatttcgtaggctctgggatcttgctcaaagaaattttggttaaatcgtctatcacttcttttgaatttaacttcaaatccttgctttcttcgtctgtaagctcgacatccgaaacttctattgcaatgtcctcttgtttgtcttcgtcattaccttttgagaaaacatgatcacttttaccattttctccaacgtgttcttcgatggccccattttggatttcctccttttcactttctgatgatggatccgatgatgaagaatctgatgatgaaacatcagctgttcttctcttcttcctccttctgttttttttgacagacttgatatttatggctgatatatcacctgccgacatcctgtataatatattatggctagttctttccgtgctatttcaagtgggcagtttaaattcttgtatatattactacaatatatgaaagttttcgctcttcgttttttgcaaatttttagtgatgagctcttcgcgcaaagaagttttcaatgcccgtaaaggcacctaattatatatcgaattattttaagctttccgcttcatcaatgcattttgtctttatatatctagtttacaaaataatatgttgctattgccttgcttttaaaggctcaatatcttggacttactgcctagaatagcttatccatttccactagcgcgtagtctaatatgtaactttgttcaactaagttatcaacccttgtgaaatgcctttgcgtgtatggaattattgcatcaactatctttaccattccgggtatctcactcaattttgctatgttatgatgcatcaaaatacatcttattgttctttgcgctatggtatgtgtttttgcatttgtattccaatctctgcatcgtttcattaacaaaattaactgttcatcatttaggatagagatggcttggtccaattcttcattgaaaatgacttcaattttgccctcttcggtatcttgtctagaccttgattcgcccaaagctcttttcaaaacattaaacaacctcattgggtgatctaaagtcattgctaacaaaaatgcatttgtccaatcacctttgctcatataattttgaagcgattgttcttgttcgacttgtaatttagctttttcttgttcttcttctatttcttgttccgtacaatctttccaaaactgaaaaacaccatctgcatcagcacttacgatcatatcaccatcattcatagtacttaaagcccataatctattattatgaccatccaaagtcttcagacattcaccgctagaacaatcccatattttgatcaagccatcagcaccacaactgatcagttgtttttgcttattaataaacgaacatctttgaaccgcattggtatgaccttccaatgttttcataacgctgaatgtatccaatgaccatatcttgactgttttatcacctgaagaagttgccaataatttatcatattggcaaaatgatacatcccatagtccacgcttgtggttggccaacgtggcttccaattcaccattttctaggttccagatcttacaggtcttgtcgtatgatgctgttgcaaaaatagaatcgttaggagaaactgacaaagcattgatatccttttcatgggcatgacgagtatattcggataccttgatgatttgaacatccatactagcagttggctttggaattatccatttcttaattgttaaatcattcgatgctgtcaataaaaattcaggatatccctttgaaactatatttggcaatccaacagcagttacggcagctgaatgaccaatatacttggcataaatatcaaacttgcagctgttctcattgtatctccaaacaatagccgtattatctttagaggcggttgcgatccacaggccatcctcagtagcatccaatgaatttagcaaatcttcatgaccttcataaatttcgacatccaaaggcagcgaagcttctgggcctgataaatcggggacgggtattatcctaagcgatggagaattggtagctaaagctaatttattcagctctgggccaacatacctcatgtcagcaataataccatgattaccagcaatgctcgaagtgacctgtattgtgtcttcatcattctttaagtcttcttcaacgttaattagttgtaatgtctggtcagacaatactaaaaacatctgtgaattgctcaatattggaagtacaccaataatgaataactcttctataggtttattggttcttttaagcacgctaccagattcagagtcaattaactgaaagatagcatcaccgccggctgtataaattatgcgtttaccgtcaccatcctttaggaatccgcatgactctacctgttgatttactggaagtgttttcaacaatttacatttctttttcatattgaaatcccagagattgatgatatcgtctctaccaccggaaagtaaatttaggcttggctcatcattatctggtacctcaatgatatccaaccctctcacagcagatgtgtgctcttgtaatgtgtgcaagcacttccttttaacaagatcccaaacctttaccataccattggtgtcaccggatgctaataaccatattttactattcaattgtccataaaacttcaaactggaaattgtaccaccatgacctttgaacgaatgagtaatgtaaccattttcaatatccacaacaattatactaccatctgtccctccgactgcgagaagcgttgaagtggaatctgcgtcgagaatgtacgatggagaagagattttcattgatctgacaactttcccggtcttaaggtgaaagatttttaaaagctgagcttgtgaaacatacgtgagatattgaccatcaggagttaatttcagtgcagtaatttcttgctcgtcttcattagaaatcttgtgcaaaatttttctggagcctggggttaaatcgattatgttgatttcgtcaagcaccggagtagctagtattttaccattttctgaaacagtggcaacagcactgcttcctgcataaatagggtttaacgatatacctttatatgaggttttcagatccatattgtacgtagtatggcttactaccgttgagagtactatgttgttggttcacacctttaatgccataccgctattatatctgagagcgatgagctgaatttttcagaaaattttcagtcgctttacacggatatattaagaagctccatcttaatcgccagaagagtggatgaggttatcatctcaactagagtcgaagagtaaggcaatccatcaaatggggttgcttgaggcttatttacttttatacgtctgattggacggattataccagtaaaaaaaatattgattgtgtttttctataaaaatatgcatatataagtaaaaaaataacatgtaattcttttcaaccaacgataaagcaaaattcagagtagaataaggcaaagtcacatactgatgatgatattgtaaacgaaaggtgatttgattgtagtaaccataaaaaaatgcaaaatagctcattgtaagacgtcattgaattcgaatgaatggttaacatcattgcccataattccttcgatatctgccaatgcactctcactaaataaaccatttttagtgaaacgaagattttcagccgctgcttccaccatactttgccttcttctccacatggaattactattttcatggcttaatgtattgtcgaattgcacaggagcggttaacgatgctaggatatcggcgtcagtatcttcgatcacatgaccttcttgtgcatcataaccgttaatatcacctacagacagtaagtcattttcatctttgcccaaaatctcatgaatttcatctaaaccaacactttttgttgaatttttccttgtattgctgtccacggcaagatcagaattatgaggtattaatgacgcatcttcaggtgcgtgagagggaagttcattcataggggtattttcattggttgtaaaatcggtaccggtatttatgtcgctatggctgttattgttaccgatgatctcatggccattgattcccaattgtaaattcatagtttcttgctcctttattgccttttgtctttgctttcttattttaagaagcttcttttttttctttaactgcctttttttttcagtttttttccgttgtagctctttcatcttatcaatcttctttcttgttctttcattaccaatatagccaatgggaacttttctgttagaatttgctggtatcatgtactcatcttcttcataggcattaatacccttatttctaaatgcagataatggaaccttaggaacttcataccaatctgcagcatggccatttgtgcttttgctattaattgcatcattgtaattgttctccatatcgtctgtgtgggatggtgaatcatcctccaattcactcatgtttagcagctcattgagtgtcaattcgtcaccgttattgccattagagcttccctctcttttaacatctggggtttgagccctttgatgttgctcgcgaagctgttgatgttcttggattaaggcgtataatgatttagtagacagaccatcaataatactaaaaggtttgttgtccgtctcccaagtacccaattttggtggacgtaatccaacaacatttgaacttacgatttcctttgcttttgagccaatgttttttgaccttgaacttgggggcggtaggttatcatcttcatctgtggattcgtcatcaacgtacacaacagtctctaagagatcatgtttgcaatctttggatccatcagaattttctttgtctgagttagaacttatcaaagaggaagatccatcgctgtcgtaatgaaagtaaaaagagtctggatctaaatcatcgatgtctatgaacacatttgtcacgctggaatcatcgtcgtcgtcttcgtaatcgtcgtccagttctgtgccaatgtctaagctatctgaatctagtgccctcaattcttcatccgtgtcagcatcgtgggacgtttcagattcactgcattcatcatctgaaggcatatgggcaacatccaacaaaatgttatcatattcatcgtcagaagaatcatatttcccggaattcaggaccgtactatgagtggatggttccagatcatcattggattttatcaaattcgagcctttattcttatgttcaatatgacttttgcccgatttatgcctgcctttcttgctcttatggccactattttcatcatctgattgaaaaaaaacattgaaaatatactcatcattgtccacattggaggttgttctcgtactaggtttttgcgtctttttatagagctttcgtctttgtttcctttcttcctgttcccgttttttggcctctttcttttttagtttagatagtttttcatcatttagcattaacggtaaagatgtactcaaggatagctttggctctgaaccatcgccataataataaagatttgcaaatttaggatcttcataaaacggcatatcaaaatcagacattatttcatcttcttcgtcatcttcttcatcatatccgttttcttgattgtattcattttgcaaaaatttattttcagcatcttctacaggatcagacccttcttcgtgtatactaccatcgaatgagagttcgtcgtcattttgtagctcagaaacaatgttttgttcttcttcttccaatatgggaagatcgtcttcccccgtttcaagatctgtaccaatttctccatgagaatcttcattgttaatcacgtcaaagtacgcatcctggtcaatatcatattcagattcatctgactctgaaatattgggaaatcgtaactcatcgttgttacctaacatcaccttagaatccagtttatcttcttcattaccattgttctctttgttttttaaatccaagacttcttcacctatatcctcgttatagccttcattaccattaccaaaactaatgccgtcgtcctcttttttgaatttaaacgatagcgcctgttgtgtagtagtagtgcctgaaccgtttacttcttttttgtttgattcttgttgtttttgttgctcttctttctctttttctttttcttctttctgctcttcttcattttctttcttaggggatagtttaactgatttatttttgttactgttctcacgagaggaatagagtgtattgctatttgtattcatggcagataaagctttcatggctcttttctttctttgggccgtcagtttgacaaaatctatattctcgtcatcagaacttgtttcgctatcactatcactatcacttccgtcatcatcatcgtcgtcgtcgtcttcgtcatcatcttcttcttcttcttcactctcttcttcttcattttcactctcttcgccatctgttacagcttggtaatcggatgactctgtgccctcgtcgtcattgtctatttgcctttgtataagtttacttttttttccttgggaattatttgaaatgttctttgcttttcttttaattttatgtgggtttgtacttttgtttttatcagaatcagatacgtcactcaaggatgactcagaagagtatataaggctaaatcttcttggcctcgttgtactcagtgtgggtggtgattgcctggactttgtatcggattcgcccttttttatgagccttttaatatttgctggcagtttaccagaatgtgtactatgattgatcgtactttttcgaggactttttttgcctgccatttcgttctgtttccagtttgccggttgttttttccttatttgtttatttgcttccttgttgaatttccttcaatttcaacaagcttgaaaatgaatttcgtagaatgaatattactatgtttgaaatggttattgcttatgatgctcaccgaagttaaaaaaaatattataggtttgtcctatgttagaattgtggaaagggaggaatgtaataaataagcagtaattaaatatagccttttgaagagttcctccttttaatttcttgtagcaagtgtttcgaatgtattcaaatattaccaatgattatacaaatacttacagcaagtcaattaaagagccgtaaaagctaaacgtcaaaacgtgtaaagcacctattatctagtctcttttccctagttgtactttaaatcaatttagtgatgagatgaaaaaaaaaaaaaagaaattccaacgaaaaagaaacgacgggcagggcaacctttagagatttcaatccgtataaagagatgtagtaggcagtacgggtaacatcgtcacaattcataatggaactatctagcttttgcttgattgcaaagttctacacccgttgatacttcaaacatctttgcaatacgtaggtaggggtcgcgtactagcagcctcctagttaagtgtatctttcaatcgcattacggaacaactaggcatcccgaaccccacacggaaaaatcggaacaataactgaaaatttcctttttcttttttttgctcttcaaagtctctgcccctctattgcgtactcgattgatttttttatcaaaggccatctcagacaagtagatctacattggagtttctcataatattatcactatcggaaggtagcataacctttaatagagtttccgctgtttgcttggctcgtttttttgtttgtactatgcctattggcgcaaagaagacagagtgtgcaaacaagagatgaatcagagcgatagcagcttgatggatttaccactggagatacatttatcattactagagtacgtgcctaatgaacttcgtgctgtcaataaatacttctacgttttgcataaccacagctataaggagaagagtttggcgtggatagctgaggacaactatatatgggccgttgtcaaacattcattatgtttatatgtcaagagtttggacccacttcgacagcatgccagagaaatcattcaagaaacgaaggaaccaggttttaatgtgccactgtgcatgactaaatacatcgcagattcttggtatattgtatacaatgcgctgcaatatcctggaaagataattaatatgggatgggacaaatataccaaaagtcaagattcaaatggttctgattctaccagtaactttaatagtcggcccaaggaaagaactcttatgcagtcgttgacagctttacctgttaacttttggtccaggaggaaggacgagcctacaccggtaaacgtttggttttatgtaaaaaatgcgcacgttgccagatacataccgaaaattattacggaaataggcatatgcaactatgggccgaagcagatcgtggcaagtgcaggatatatcaacgaattgataacatctgaaggaatatactgtgttaacctaggccaccttcccaggctatacgatgagcaaatttttgaaggcactggaacgacacatcttcccctggaactgaaagctatcgacaggacagattcagatgtttgtatcaatggtgatttagttctactcggttatgactttattccatatcagatatcgaagccgtggttactctttagaatcgaacccgtaaatagcattgaagcaatcttcaactatagtgaatgttctttttcataccagtttgcatggagtttggcctgcttacaatctgaagagaaaatttcatttcctagagacacgataattgggcacggtttaccttacaagccatccaaattgataagaattttcgtctacaagcatccggaacaaaagcaagatcttggtcaagaaatagcattgcccaactggaataccccttatcttcgaagatgaaaaaaaaatttatcaattagtctataatatatgtgtatatacgtctatgcacctacctacttataaatggatataatattcttgcaatgatgaaaatatgtatagtcaaatttcatttttttcaattgataaatgtactttcaatgatggaaactccttcatcgtcatcgaatttagacttctggcagaattggtaaatgaatggcttcatgtttgccagattttcagcaatagacctaatgaaagcgggcagctcactcattatatcgtacctattgactaatcttaaattagattcttcaaaaccacgcggaaatgaaatggatgtaggatatttccaaccattttgcttatcctcttttgtagatggaaatttaacagcatgatcatttacacttgacccgacctccaaaattttgtccttatcactaaccgcccatatagtcactgtagtgctgccatattcttttgttgtggtgaattcaatacacatcatcgaacgcttctcaccattgaaacaaagaaaattccatttactagccgccttattgggtattagcccctggacagcatccagatacaacataggcgtgtccttcaagtccagcttcacaggtttatcgtttttcttgtatgagatggtaccattgcaaaaacctctaggaacaaaaacatgtcttatcatttttctggacgtactagaagagtctctttttgctaactcttccaagctgatgctcttgtcaaggtaataattggaaccgtccgggtttattatgaatccttcttgtaaatttacggtaatgtcaaccttcaaatcttttagtaaacagcttgtacttcccttcggaatatctatcttaattaataattgagcaaatccactggaggaagaattttccaaaggtacgaagtgaaacgtaacattgtccgattcaacttttaacgtatcaaaatctttgatattatcaattttaaagctttcccatatatcaatgtcttcttcagagttttcctcactgctggctttaaatattttgaaatttaactgaaaacctttgtatataccgcccataacactggaatataatagttgaattaatccacatttgccgttggtgagatccgtaaaatacagagtttgtgtctctattcttgtttccgttggatttcttactgcttttaataaactatgtgacttgaactttttgtgatttgacgtcctgcaaaaccattctagtttcgatgtatcctgaaatttagtataattagcatgatccttctcggataaaacttccttaacgggggcaaatttcgtcttctcctttttgatcgcaaccgccattttttctttgctctatgatttttatgttaattaaactgttcgttgccctaaaattttgaaaatttctcgaatatttagagagaatccgtcactattttagtatctatcttgtctatttatatataaaatctcattcccctgttatggtttttgccaagccctatcccaaaaaaccaaatgatacatgataaacctatttatcctctttaacagacctatcgtttaaagcttttttattgcaaaccctattcattatggctttttgacctaggtctcattgtgacttctatttttcactgttcagtaaaaaaagaaaagtgattaaaaagtatcactatttctgttagaaagcaagtagctattttgattggtaattatatacacatattgaaggaggccgtagtattttcgtttaaaatatattacagtaagataatgtctgctacatcttcaagtggtgacgtgaaaaaatttcaagctgtaccaaaaccaacgagcaatgcatcaccaccaccagcatcgagtgggtttaacgcaaggaccctatggccggatttgatagaaacaccagaaaaccagtgggtttttgagtgcaaagatattattgaaaagataggcactaatggaccgatagcagtggaaataaaaaaaaatatggaaaaatgcttaatgtacttttacacacttaaaaaaaaattaaatctttttgatcacacctatacggcatcatgcattctattttacaggtattggttcatatatggaatacctacagccataactgaatgtattcatatatcacagggaattctggtcaccgcttgcaaaacaatggagaataataggcctatagaggcctatattaaggcgacttgtgagtttttgatgcaaaatataccgtctttaaaaagtcgaacaaatattgataaacttaaatgggaatttagagataagttagtgacgaatgaaaaaaaaatactatgtttatttggctttgacttaaatatcagtaatccaaaagaattgattgaagaagtgttcagtggctattatagattcaacagggatcacaatctgccagaaaactttaaaaaagcttttccaaaaattcttcaagaatcaagaaattttatggtccaagctgtcacccagccagtttctttattgtgcgacggttatacgttcattgtactatctctcatatactgtggtttagagtataaaaagcttgtagacaaagatttcagatatccgaaaaacttcttcaaggatagattccctatcgaagtaacgccggaaaattttgccaatatctttaccgattacaagttactggaagagaattttttcaacttaaaaagtaataaaggtgctaaattacaaattgattcaagcatgattgattcggtgattgacgaaagtggcgatgtggaaaatgaagtttcagaaatctctgatccgtttaactacgagttgattaaatccggtgaggtgaaggaagagtttttgaatcatattgaaacaagggttaaagatttactagataaggctaaacaagaaagtatgaagagaaaggctaaagatcctataagaaccccagatgccaaaaaacctaaaatataaaaatagagtacaagttatgtttaattggagggatcagtaaaggtttgatatatacgtgacaaaatgtccggcaagttccctatgttatcctgatagcaatatttccaatactcaatccaatgatcatctgtttctggatctttaggtgagtcaaagcgcagtttctgcttcaattttgttttcatcttgtctattattattctgggatgtctgaattggtaagttcggggatgataatcgtccagagattctgaacagtcattatcttcggatattttttcagcaacaagtaatttcccctccatagcagtcaacagtaccttaggtagttggtagtcagttacttcatcaggattgtcacaagcatcaataatattttcgatgatacataagcattctatggtcaatttatccatttcagatgatgcttcgaatgtgtattcattatcttgcatatagtatagttttaatacataaaaaaactggataactttaaattgaacacctgatgaaagtaataagccttccagaattttattcaagcagcatataatctgagggtcatttttaagtttgaaagttattgacagaatatttttttgaattgtttcattcatgtggttactatctactaatagtccgattctgggaccgaacacatcacattcacactcccaaatttttcctctcagaatggctaacatttcttcgatttctgcacaatactgaaaaaactgactaaaaacaaaattttcattgacctttgaaaatttaagcgttatcttatccatcgcatcgaaagcgacgcagtataacgcctcaataacatctacctcgtcgagtgaccagtgccattgaagtgacttggtctcctcatttaaatcgaagccatgggaataattagggttttgtcttttgataaaattttttagattattgcctaccaatgcttcattttctttcaaatcaattagaaaacagtggcaacacaacatggatataaatagttcgcaaagttcataaaaagctccaatttgctcgtctgcgatacttgcaaatagtcttgtcctttttgagtacgcaatgaattgtaagcaccagcgaaaagattgaaatgcgaggttataatttttatctacatgaccaaatactccttgaaataattttatatatagtaccagttttaatttattcattgtctctggatcggctttatctttcttcattatcttgatgatatgttttggacccatcgcaagattaaagtttaaaattttggccagcgcttctttcagaaggttattggtttgaatccttaatggtgaaccttttttcatgatcgaaagattataaaaaactacatggtacggaatataaagagccaaaaagtcccttatcaaatcaccattatatgcttgtaaatttaggatagtcttcacagcttttttaaattcttttcttaaactttttttaaaagtttgatagtcgacgtctttattcattatacgtgagccgacaatttgtgactatgatcaataaatagggcatatatgtacaattttgtttgtatttcctcctgttggagatgagtagtaacataatcatgggtaaatcgtcttctctgtgacagcgcaaacctttacgcccaataaaaatttgacagaaaaattctctatagtgccggggcacttcattcaaatttagtaaatagaacttttgtggcaatggacaggttcagctactgcatttcatatgcgaattcgctgctataccagttttgtggccccaaaatcacccggcagacagggtctggtaacacgtcataattctttccctacttacgaacgtaaaggaagctttgccaacttttagagaaatggctacattaattatgaactggagtgaaacaactgtgctaaaatgatacgatctagtaatttataggaaaaagtaaagatggcaaaaaacaaaaaataatgagagctaagggattcgaacccttgcatccgaagatatcagagattttagaggttaaacccacctaaatctgacgccttaaaccactcggccaaactcccattgtatgttgaaaacgatggattatacaagccattgggttagccatttatttctaaagtctttttcttggctgattacttattaatgagaaattggtaaagtttgacataattgttgggattccattgttgattaaggctataatattatgtataagaataaactagaagttctcctcgaggatatagaaactctcaaatggaatcgatatttctacacaataatattacgattatttctccttccgttttatatttttcattatcttattacattatcaatccttccatttcagcttcctttaacttcggttgcatcttctcataccttatgtcatcatctaactacccgtatatgataatatacgcgtagtaagactactagttaatgacgatagttgatttttattccaacaattaagttagcaaatgtgggaaagcataaattatttgggaaatgcatatatctccgcgatttccctagcttaggagctctttgggatcgatatcatttttgttggaatatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacattcacccatttctcagaatagatgtgaactctttggttttcggtcagactagacgtcagtaaatagtttgaaagcgagaataaaaaataattgtaatggataatgaaatgccgttaattggtagtattaatgaagaatgaatatccatcttttcatgcaatataagagaaaaatataaaactgctgagatacggacaaaaatcacctatgtacaagtatttattttatcatatacggcgtaagaagatgacgtcaaaaattgaggaacagtcatcgaatttaatggaagctgaaatgcaatgatcgataatgtaataggataatgagtaacaacaattaaattgaagaagaaaaaatagtgatgctctgtagagatgtcatttcccttcaatgttgctatattctcctggcacattaacgtatgcccactattagtgcctttaacaatagaatcccaacaattattcaattattcacccataaaatccacctatttttcaagaaagcattagatttgctcattattatttattattaacataaaagtgcctttggtagttactatgtatttagtgtggtgacccgtattcctcatatatataagtagctaccacattatgttcaatcaatatatctttaactcagctcagcattgtctgaattgctcgcttaagtttttatcctgtgattagtgcatttacacataaacgtataccgggtgtacctcaatatactatgtaaacatttaaattgttaccataacaactcatgttattattaatgatcacttgacaacatataaaaacgaaagaagaaataataatactactatgtataagtatccatttccttttgtggattcctcaaaatggccagtatattcggaagtaacataatgtagttattcatcgatgaggttcacattctgtagcactgacccatcgaaagaaaagagtttatattttgataaattacataaaagctgaaaagtttgtagtggtcatagaaggtaacccacctcctaagaaatccagcatcatatgcataccaccacctccactatactcatcaacatcctgtggtaaaacctgtgatacgctatccaagaaccacactttgtcctttatttctgtggtataacctctcaataatgtatagtaagacctcattattctcatggcccctaggtcgcctgtcattaataatgctaaaaaagtcctatccaaaagagcaggaaatgagaagactctcaacataaaatctaattgatttttttcgcgatgcagtttgtccaaatatgctaaagttatcaagtacggtgaatcaatttctacgggatataaatctgctatactttcgtcaaagcatacgagttccgatatcgtattattgttatttccatcaccattattgctattgtcattatcattattatgattactttggttgattacagcttcacccaaatcactcaagtcaacagaaattaagttataaaacttggatgtctccgacaggggccatacagcagttagtatagttacggcgcctttaacatggaaaatccatgccgttggtgagctgcttgaagcatttgccaatgaatctaggattaatattagagcactagccaccaaagcatctgtgttatcatctgaaatttcgagcacagcctctcttaacagtctcaacgcttctaaacgatgactagacacgtagttatccaagccggcttcagttctggacaaatgagtggcgctaaaagccaaaattgtatgcatcaagaagggaaaatgaaaagccaaatccggaatataagtgctccatacttcaggaccagaaatgcctgcttcggttatggtatgccatacgtcagtacaatagtgatgaaaaagttttagatctatcaaattcaaatttgattttctagacagcccgactaattcagggactagtcgtgaggctgatgaagcgtttgaatggggagaagattgttgttgagtgtgagaatttgatgaacgtggagacaatgcctccgagttggataacaggtcacccattggggacgtcttcaaagtaggagaatttcccaaagcggtcctgttgtccggtatagataacaatgactttgtagaggttacattggatactcccgttgaaggggacgcaatgttttgatctatggaaggtttggacaacgtgtgtgggggactgattgtgagaccggtattgtcgattatcaagtttttgttatgagatagtatatcagaagcagtaactttattttcgtttccgttaagggggttattgcccgaattaacagcatccgtcttagtattatccaatgggttcttcgtaaattgcttgtttttgtcctcctgttcctgttgcatatttgcgagtgcctcctctgctgtgctaactttgattgctctgttattagatgtagcaaactttccgaggccaaataactcttgaaactcagaggccattccatttgcagcaccgtatggaaataatgtattgaagctcttcatattgaagttcaagcccatcttgttcaattgcgctagctggtcgaagggaatattgctgaagggggactgtgttccttgttgttgtggaatttgctgattttgttgttgaagttgtggctgctgcaatccattcgtcaccgaatttagcctaccaggcgagagtaagccgttaaggctacttgataaattcatggccgttgattgaaaactaggtgttatcggtatactcaatggcgaattccctggtagggccatgtttgggtggttgttgtttatcattgaactgggagctgtttgtgttatattattatgcgcttcagctccatttgcactgctgttggtactgttactggtgttattcactaaactcgctaataggtgcggtaacaaaagattctccatattattggatacggatggaggaacgctattaggggaattgctttgttcatcagtaccaacatgtggcaacagttgctgctgtaactgaacttgctgttgttgacgaaattgctgttcttgttgatgatgaagttgctgttgttgttgttgtaacatgatggcattgtcactcagatttttcttgcctaccctatcgtggaccgctgatgcaaattttgacgacgaagaatcttttcttcttcttggctgaatagggctgtaaacacagtccaatttcatgtttgtacatttcttgcaaaatggtttgccttcatcacattttactcttcttcttttacaattgtcgcaaccggtcttggacttgttatgaaacttccgtttccctgtcgaagtcttgctcactttcttgcccccaacctcaatcagttcagcatccttctctctttcttgtccagcattcccatcatcggatgtcatgttatgttagatggagatctatggataaacgaaatataaaccttaaatgaaaaaaaccgtcgacttaactcctctatattatgtaaaggcgaaatgttatttgtgcctttgaaaagtggaggtcttggttgcttctccttcgacgataatcgatttcggtgactagttagtagatgatgtaatcgtagacgcagggaacccttgcttttccccaatcgtaacaaaaaaaaacaaggggaaataaactattagatagtacgagttcgttaagttaaaaaaaaggctataaaagtcgaagaacgaatgattacgaccaacatctattgttcaaacttgccttcgttgagtttatcgaacgcgctcgtttaaatttttccgacaagaacgaggaacgagtcaccaattacgttttcggctctgtcggttgcaggatctgtaaaagcgatatagatacacacgtcagcatgaagctcttatgatttggcgagtagtgttagtacgttaaatgctacgactcggcatatactgtgctcgtttttatcagtttcatccgaggattgtagcctttttttttcatttgttgatgtttctctagtattttccgtcttgtagtggtttcgggtatgttgaacataaacattaaaaaagacgattaaataaacttgagtttgtacaaaggaaagctgtagtcatagagtatttagaaaaaaaagcagccacagtttacatgaagatgtgaccaatgaggaggcatcggtttgcctttgaatctcaatcgcttgaaaattgagttcttttcgaatgatgacacctccgagaaatggcatttctatgctagcgccactctaccctttcaaacgtccgtactcatatgaagtttcatccttcacgcagcgatctaaaaagttgtaaaaaaaaatacatttaggcctagctatatatgctactatgtatcattcagtgaaatggctgaggttatataaaatactgggaggtcgtttttacgctaaagcagaccttgcggatcttttcctgtagaatatatttgtagcataagtccaattttacgggcgcattttcaaaatcaaggtgatattgacatattttgaagagcacccaatgggctagctgcaagaacaaagagaccagaaagcctagaattaaatgccagaaaaatggaaatttattctagacaaaaattgttcggcacctctacagacgtttaacgaacctggtccggcctttgaggcgatcaaaaaaaggcccatttttgtgttccgcgtaattggtttgcgcctttccatggagcttggtgggcgacattctcaaactggtttcctgatacatcatgcacgcccgtaaagggtttaagtattgattgctagcctgaatgtttcatatgcataccgtgtctatgcaacgaatatatttcagaaaaaagcacgaaagccaaatttttgatgttaagaggtgtttttgcccgtaaacggagaagacgtggtaggactcgcaaatgtcgcgtttagcgttgaagaacatggaagtattgaacgtttggggcttgacggctcgacttttttgcactactccgccttgaacagacggatgatcctggcgcaagaaacaaagagaatcaactctgagcaaagcgaaaaaatgaaatacaacgataataaaaggataggaaggtgtatatataagttaattttagatatagattaagaaaagatgggcatatactaatatgactacaaaattgcacattttttacttttcttgataacaggaggctccaaggcggccacgatagcttcatcgaatacattcttcaaaccgcgttgtgttagtgccgaacactcgacatattttactgctttcagttctcttgctaacctggaaccttgttctgatgtaatcggacgtaatctttgtctttgcaacttctcgatgattaccttgtcatcccttagatcaatctgcgtaccgacgaccaggcatggtacacctggacaatggtgatgtacttcagggaaccatttttctttaacgttttcaaaagagggtggggaaataacactgaaacaaaccaaaaatacatcagtagaaggatatgacaagggtctcaatcgatcgtaatcttcttgaccggccgtatcaaacaaacctaacgtatatggttcatcaccaatcatcacagtcaccgcatagttatcgaacactgttggaacatagtcggctggaaattgattcgttgtataggagattagaaggcacgttttcccaacagcaccatcaccgacaacaacacactttagcgtttgcattttgtggaagagctaatacgtttatttcttgttttataagttttgcttctctaattcgtttgttaacctatctcctcaggaaaatagaatagtataataaataacgaatataattttttgcgacaaaggaaacctattgcaaaaagtgaagaatgacagagaaggataatcagtatatctcggtacacctggaacctatttatcaaaacgctgctcttgccttttccaagaatcgcgtctatcatcgatcaatcaaccttgtttgcttttttttatcactttttcccgtatcttgtttcatttggaagggcccaatggaagcagtattacccgtattgaatgacccttgaatcgacggtggaagacatctttaatgcgatgtttagaagacaatgtgccgtatttacctgtatatgtggattatctaacagtctacaatacaaaattaggtgtaacgtagctacaacagttgatagaaataatgcaactttttttaaaaaaaaaagagaaagtgctcgaggtggggattgaacccacgacggtcgcgttgcttttaaaggcctgtttgaaaggtctttggcacagaaacttcggaaaccgaatgttgctataagcacgaagctctaaccactgagctacacgagcattttcgaaagagacgtaaattaaattgttatttataccgtagatgattgtttttcacgaaattacccttttgagttccggcttgtttcgttcaacagtactaccactgataagttagcttcattattggaagaaggttgataaatgaaagaagattcacgactatgcacggcaactggtaagtaatacacgggcccagatatttattttaattcttggaaagaaagtataaatttataggttcgctatcagtaagtatacgaatttcaaactacgtcatatataatatccaaaagaagatgaaggcgatgcggtcactctaggactacaacttatccatcgcctcatttagtgcattcaccgcaatgtatacatctgaaaatgtattatataagggagcaggagccaatctaattacgtttggtcttcttgcatcgccaatgacaccatggtcatgcaaatattggaaaactttgggcataatatcctcttttccagtgtcagaatcgaagtaaagtgacaattgggcgccatgttcttcatctgtgcttgttggagttaatattgtaaaaaaacatggtaatttctcgatccttaaagggtgtttgtaatacttggaggcttccaacagttccgtcatatagttcgtcagcaacaacgatcttttacgaacttcattaataccattaaacttcgcaaataattccaatgaacttctcaatgccactgtgtcaataacgcttggattagattgcctgaatcccaatgctcctggaatcggctcgaatacttccagcatttgaaatcgcttagcaggatcattgccccaccaaccagctaatcttggcaaactttccttagcagggtctggtttagtatgcttcgagtggacaaataagccaccaattccaccaggcccggcattcaagtacttgtaagaacaccaacaggcaaagtcaacaccccaatcatgaagttgcaatgggacgttccctacagcgtgtgctaaatcccatccaaccaatatgtcggggaattggtgggcaaatgaggtgattcggccaatatcgaaatattgccccgtgtaatactgaacacctgacaaacagaccagcgccaattcatcttgatttacctctatggtatccaggatatcttgagttctgatataagtctctccctcgcgtggctcgatctgaataaaaacattctcaggttccgaaattccatgaattttgcactggttgtagaaagcataatagtctgatggaaaggagcccttttcaaaaaggatcttgaatcttttctcagtaggtttataaaacgtaattaacaatgaattcaaatttgcagtgagactattcattactgcaacttcattttcttgagcacccacgatgggggctagtagtggaagaataggtaagtcaatgctgacccaaggcacctttcctctggcttcttcaggatgtttgaaatgcgattccacagcacaatcgctccacgcatctagctcagcattaattgaattcctagttgacttcggcatcaaacctaaagaattcccgcataagtacgtcacaggcttatcgtcggacgatagtcccatggatttaaatgtagggatgttgaattcatccctcagagattccggatattctccgtctaattccaaagctttctccataattaccagtttgtttcttttttccacagaatatttaggcttaatatgtacgtattgacagcatatatatttgctgtcttgaatttattatgctaataaataattatgtttttcaagcgcagtcacctatttccaaagcgatgggtttgtccgtgccgtagacggcatcccgtcgttttaataaccgttataaaaaccgcccccatattttcgtgggttgacgacgacaggcgtggacgacgttaattgacgtcgtcataatatatttcatattatgattttttccctcaccattacttgttctctcaagtaggagtatctggcacttggacggtgatgtcctcatcagcatcaattgcttcgtctggatatgagagaaaatcagaggatagtgggccagtgatagtttttctccctcgtgaagcagcatgttttaccaactcagaagaaacgccatctttttctgggagcggagacaatttttttgttctccggacatttgcaaattgtttttccagttctgtcacagctattttcccggctcttttgcgctgttgttcatctcttttggcctcaacttttctcgaagagactactctttcctgttgtgtttttacatttattttggaggaaatttccgataatgctatttggcgttttattttaatatttgggcttattaaatcaaacttatatttgctggcattccatatgacgccggtgtcatttttctctaaaaatttcatgccagaaaatattattgatctaattcgcagaacacattcttcttttggagaaagcactttagtcaatgtagggcatccaattatattattaatcatgtcgggagaatcatacacataatcgtcattaaaatctgttagtgcaaagttaatgcaagaaaattccctgaaaataatatcttctctaaaaagatagcttcttttcggcctgtggctatatatatttcctgaacaattcagtggactatttatcaagtcgttcagcaacaaggcgaatgaagtgcaaaacttcctgtgtctgtgagtgtactgcaaaatagatctatatgacttaatccagcacataagcaaacgaataatggctagatatcgaaagtcttccatgtttttttgccaggagggtttgatgacgacgtctatgatattagcaataaaatcaaagctcaagtctaaaaaaaaaacctggcgctcactcaaatctgcatatttgagtttgttcttttgttccttactttttcgagttgtaaacataagatcgaaacttcccattgtggcagccaagttttcaagtataacattaatattacctgaatgatactttaatgcagccatttgtaaatgctctttcaataaccaacaattagaagcacgtgatgcgttccatgactgtggaaccaaagtgtgttctactatcgatagaaattgcaaaacaatttgaccttcaaagaatgatttctcacctttgagatcttttgacacaagaattgccaattttttcatcagacgtcttctttccggaaaatcaggagtcaaaatgaaatctttcaaattgtttaacgcacatttagacggaatccttaccaatgctcctcttactaattcaaagaaatacagtgagaatttcccagtgatcaagtaaattttcgctcgttgaaaataagtatctccaacggctgggagatagagtgaggcaatattcaagtacctaatagacttctcaaaaccttccacactcttgggtttgttagacggcttgtttagtagtgttttataaaaatgtgtggaacctagattaatcacgcatctttgtagtgagattacaatggaaaacgtcagtggattactcgtgtttaagataattttctcatgagttgaaagtccatctgtgtattgcattaaattcaacttcgcgaagagagcatttgaaataacggaattcatatcgtactttgcgcataggtgttcgatgatgtcatagtaatacctgtgtgtaattttgaaaaattgaatcatttttttttgaaaaattctaaaaactctgaactttcttctgttacttagtcgcatgatatcatggaaccagtgctcaaaccattggagtgtaggttcgtgaatttgaagccataaaagtttcagaaccaatggtatcacggaatcatttatgcgttcgtaattgttattatggtacatattttcttgtttcaaaagtagctcttcgagaaacctagtagatttgcgatgtattccatccaggaagcatctgaacgtgatatatgcattttcatcgcatgtcaaccttgatgttagatgtttatccagatgcgcacgagcgttcttgaaaaataatctcatacattcttcgttaacttcttcattatccattatctatggtggcatgtgtcatttaatggaatatactttttcccctgataagtttgctaaaaacggtcggatcatacaggcatgttaacatttccattatcctttttgacattggataatggcgtgaacgcgaaaatcacattgataaaaaaaagcagtttggcgaattagtaactgtcaataaagagggcatcgcttttgaaagcaccttcgtctgtgcgctcgcttcagctacgtaaaggtgtattatagacaataatgaaagtgctatgtgtcgcagagaaaaattctatagcgaaggcagtttcacagatcctaggaggaggcagatcaacttcaagggattccggctacatgtatgtaaagaactatgatttcatgtttagtgggttcccgtttgccagaaatggggctaactgcgaagttaccatgactagtgttgcagggcacctaacaggcattgatttcagccatgattcgcatgggtggggaaaatgcgccatccaagagttatttgatgcgccactgaacgagattatgaataacaaccaaaaaaagatagcaagcaacatcaagcgagaagcgaggaatgcagactatctgatgatatggacagattgcgaccgggaaggagagtacatcggttgggagatatggcaggaggccaagagaggcaacaggctcatacaaaatgatcaagtataccgggcagtcttttcgcatctcgaaagacaacacatattaaatgcagcacgaaacccaagtcgattggatatgaagagtgtgcacgctgtaggcacgcggattgaaatcgatcttcgagcaggtgttacattcaccagactcttaacagaaacgctacgaaataaactgagaaaccaagccaccatgaccaaggatggtgcaaaacaccgcggtggtaacaagaacgactcacaagtcgtatcgtatggtacatgccagtttccaacgctcggctttgtagtagacaggtttgaaagaatacgaaattttgttcccgaagagttctggtatatccaattggtagtcgaaaacaaagacaacggcggaacaacaacgttccagtgggacaggggccacttgttcgaccggctgagcgtgttaacgttttacgagacatgcatcgaaaccgccggcaatgttgctcaagtagtagacttgaaatcaaagccaacaacgaaatacagacctttacctctgaccacagtggagctacaaaaaaactgcgcccggtacctgcgtctgaacgccaaacaatcactagacgcagcagaaaagctataccaaaaggggttcatatcgtatccaagaacagagactgatactttcccacacgcaatggacctaaaatccttggtcgaaaagcaagctcaattggaccaactcgctgcaggcggcagaaccgcctgggcatcgtacgcggcatcgctgctccaacccgaaaacacaagtaacaataacaagttcaagtttccacgaagcggctcccatgacgacaaagcgcatccaccaatccaccccatcgtaagtctggggcctgaagcaaatgtttcgccagtggaaagaagagtatacgagtacgtggccaggcactttttggcatgctgctcagaggacgccaagggccaatcgatgacccttgtgttggactgggccgttgaacgtttctcagcttcaggtctcgtagtcctagagagaaatttcctcgatgtttacccttgggcccgatgggaaaccaccaagcagttaccgcggcttgaaatgaatgccctcgtagacatcgcgaaggccgaaatgaaggcgggcactacggcgccgcccaagccgatgactgagagtgaactcattctcctcatggatacaaacggcattggcacagacgccaccattgcggagcacatagacaagatccaagtacgtaattacgttaggagcgagaaagtaggcaaggaaacctacttacaacccacgaccctgggtgtctcactagtgcacggcttcgaggccatcggcctcgaagactcctttgcaaagcccttccagcgcagagaaatggagcaagacctcaagaaaatctgcgaaggtcatgcctccaagactgatgttgtaaaggacatagtcgagaagtataggaagtactggcacaagacgaatgcctgcaagaatactctcttgcaagtttatgaccgtgtcaaggcatccatgtaaggcgtttttgccgccctttgtcttcaaaaaagctctccgcttaattgcatgattcagctgactgcatatgtgcattttcagtaccagccgcaactgcatcaaaccatgcagaagtcgccgccacagaagctccagcgcgccgcgtaaacgcatgttggaaggcgccccaattagcatattcacgcgcgactaccaaacgcatagggaaggtttcagagagccgatgagcagcggatgcacagagtacggccataaggctgcaaagcgcttggcaggaatgggcgttttctagaggttgccttattgatttatatggaagaggagaggattcatcgatcgggcttctaaggcaaatagtatgcatacctttttcgggtagttgaagagaaaagaggaagagaatagaaaaaaaaaaaaagcgaaatttttacatcctctattgtaatgtaatttctttttttttattaggtatatatgtgagatacaattctcgaagtcatcgggaagctttaccatttcatttcctattccagaactcatattagcatctattgttctgagattcatcgcaacatcatttaaaggactgtagagccaattgcattatatcaatatgagtttcggtagtaaagtctccagggctttgagatttttggaaattcctgtcaaagacagggcatctgtgagtttcttgaagaacccggatttgcaacctattaagtcggctaaccaaacatgggggttctggtctaattttgcatattggggtgttatgtccttttcagtgggtacatggatgagtgcctcttctgcactaggtgttggattaagttacccagaaaccattggtacatttatcgtcggtgatgtgttgaccattattttcacattggcaaactcgtgtcctggttacgactggaaggtcggtttcactttggcccaaagattcgtctttggtatttacggttctgccttcggtatcatcatcagaattttgatgagtattgtcaactacgggtccaacgcttgggtgggaggtctttgtatcaatatgatcttggattcatggtctcaccattatttgcacctgccaaacaccttatcttcgaaagttgccatgaccactaaagaattaattggttttatcatcttccacgtccttactgcattctgttacttaatgaaaccctaccacatgaactacattttaatttggtcgtgtgttgctacatttttctctatgttgggtatggtgatctatttagctaaacaggctcacggtgttggagaattgtttacctccactaaatccactgccactggctccaccaaagcttgggcttgggtttatatgatctcgtactggttcggttccgtttctccaggttccaccaaccaaagtgattactcgagatttggttcctccaattgggctatctgggccggtaccatctgtgcattgttaattccaaccactttaatcccagtttttggtgttattggtgcctccacctgtgacaaactatacggtgaacaatattggatgcctatggatatcttcaaccattggttgacaactaactattctgcaggtgctcgtgccggtgcgttcttctgtggtctttcatttgtcctatctcaaatgtcctacaccatctccaactgtgggtttgccagtggtatggatttggccggtttattacccaagtatgtcgacatcaagaggggtgccctttttgccgcatgtgtctcctgggcttgtttgccatggaacttctacaactcttcttctactttcttgactgtcatgagttctttcggtgttgtcatgactcctatcatttctgtcatgatttgcgataacttcttgatcagaaaaagacaatactccatcactaatgcctttattctcaagggtgaatactatttcactaagggtgttaactggagagctattgttgcctgggtttgtggtatgacccccggtctacctggtattgcttgggaagtcaataatgactatttccacaacactggtattgtcaatttcttttacggtgactccttcttctcgtttttgatctcctttttcgtctattggggactatgcctcctcttcccattcaaaattactgtcaaacatgatgacaaagattattatggtgcctttactgacgaagaagcaagaaagaagggcatggttccatacagtgaaatttctgaagaagaaatccgcgcttacacattaggcgaaggttacactaccggccacgagtacagacctgaaggctccgacgatgaaatacctgagttggtcaaaactagctctgaaaacaccaatgagtttgaaatagttcatcataagaataatgaaaagcaatcctccaccgccagtgaaaaagctgcttagtgggaaataaaattgcaaaaaataattaagaataaaatttccctttcatttaatggctctctgcactaatttttttacctacgaaattttccttcgttcacacttaatattaaataacagctctttcctaataataacatatacactagatatataataccaaataaattaaaaaaaaagaaaaacaaaaaataacgtagctttgttacagtcgtaaaaaaaagaacaataaaccaatcttattgccagcgtctaactagtcctattatattccaatatattaaggggtaaggactactattattcgccctgaattgaaatcttttagaaagcacctgttctctctctggtgttctttttttctcatctattatctaatttcttcaaccttcgttatttgttgttattccgtaatcgtggtgctcaacttttgaaatttcacttgtttaccataacggaacataattaaaaatttgttcttgaaagtcacaagcactacgtgaacacaaaattaaggcaagagtgacaaagtaaccctcacaaggagcctgtcgttggttatattggaagctatagatataatcgaatccaatgactggtcctggacctgaaataaataaggaggagcaccccagttctccgggcaagaaacagataacatataatagtatacccaagaatgcaaatctaattgatggatctacgaattcatcgaagaggccaattgaaaagtatgacaagagaatagccgacccaacaaaaagctattttccacatagcatatcaagaacaccaaggagaaaatatacttacattctagtcctcacatcactaaatggaacttttgagagcaaacatgtggtgataccatttaaaccagatggtttgaaattgggaaggcctgttgctaatagtaatagcagctccagttcatcgctcaggggcggtaaaagagtggattcacacactttttcccaagtaaggtccgataatggtaatttcgattcaagagtactctccaggaatcatgcattgttaagttgcgacccgctcacgggtaaggtatatatacgagacttaaaatccagtaatggtacgttcattaacggtcaaagaattggctcaaatgacgtagaaatcaaagttggcgatgtgatagacttgggaacagatatagatacgaaaattgagcatcgaaaaataagtgccacagttgaagaactatttgtacaacctttattagaatcaccgatttttgaaaatgaagatagtgatgattgccatacaattacagaaaaagaggaggctgctgccataacaagtcacatatatggtgattccaacaacctagaattggaagaagttatcctgggctctgatacagaaatactgagtggaatttttattaataattgtattggtacgagcccgactttatctaatatcatcaaaaccctggcaatggaaattccattttccaaatgcgataattttaaattacagtcgatggagaatttcttaattaattatacgacacatctagaatacacgaacaaacttttagtggaaaaaaatgatcagcaactggtaaagctgcaaaatggattaagaaggaaactgtcggggaaatacgaaaagattatcgaacaaaacagaaatcaagtaaaacagttggaaagggaccatatgtttttcaaaaagtcatttgaagtgaagaaaagaagaaataatgaaaagcaaaaaagcatggaaagggaaatagaagacttgaaaactaggttagaagtggaacgatataagaattcacaaatgatgaagaagaacaaacagaaagaacaagaactctcaactgcatctaaaaaaaagactaccgaacatgacactagaggcgtcccgggcatgaatcctaagggtactgacaaatttagcatcaagaacacgctatgtaatcatttcacactattaacatttggaactatttccatcgggattatagctattgtcttcaagatcctttcccccaactagcatcgtaaatacaagacacacacgatccgcttttcacgtcagagattattatatacgtacgtatatatgtaatagatattcacatgtaaaaaaaggtaagcatcctttcatttaagaaagtatggggggagtcatccgtctcacggattctttttcaaaatattgacgtcgtcaatttgcattctttccaaagtttttattcctagcagctttgtcatttctttgacaaaactaattgctacactttgcacatttacaacagcatcgggtcgttgttccataattgaagtagtcagtgtatttttcaaaccgcacatttcaaaactattcatatacgatagatctgtattaacattaattgctaccccgtgcgatgttatggaacgtctgacgtgtattccaacactagcaactttcttcttgccattttcaacccaaactccagtgtcctttgtagtcatagcatctaagttcaaaggcttgtcagtgtcgtcgcacatcttggtattcttcaacgttctgatagtggcctgctcaatgcatgaaaccaagcatttagcagggaaactttgaaatgttttcaaatctaaaataatgtaaataacaatttggcctggaccatgaaatgttacttgtccacccctttccacttgaacaaactttggtcgtgggttgtccttttgcgtttctggaatgaaactttcataagccgctatctgatctggcgtcatagttttcttaatcctcttcccacctgtataagttggctcaaactcaaacgttaatattatcggattaggtttcattgccataaccttgtctaatattcttttttcgttatcatttattgttgcagtgcccttatattcttcatccaattgtattaattttctctcaatcttcgattgaatgtctttgatgtccaaatttgccctaactaatgtctcctgtatttccaatcctttttgaaaaggtattctttgagtgaattgtagatgtctgagcgtttgcgctgagggttttataggatgtgtcatttccttgagagcagaggcataagtgctaaagcattgtcgcctacagacattgaagtttgtgcatacggactggcgaatacacctcgacatggggctgaagctttcgacaaatcttaaattgtgactttgtgcatgaaatttttatatgaacgttttaaataagtggacatagtccttcattcggtatatgcagatccggcatcaaacactttttcaagaaagtttgagtcaaaaggattaaaggataaagtaaaacaacaataacatctccgtgaagcattgagggaagggtttaactccaacaatgtcactgaacaacataacattctgtgtctcacaggatctggatgttcccctgaaagtgaaaatcaagtcattggaaggacataagccactgttgaagccatctcaaaaaatcctgaaccctgaattaatgctgatagggtcaaatgtattcccttctagtgatctaattgtatccttacaggtatttgataaagagagaaacagaaatttaactcttccgatatacacgccgtatattcctttcagaaactctagaacctgggattattggttgactttgcccatacgtatcaaacagcttacctttagcagtcatttacgcattattttgtgggaatacaatggatccaagcaaattccctttttcaatctagaaacgagcatctttaacttaaaagactgtactttaaaaagagggtttgaatccttaaaatttcgttatgatgtgattgaccactgtgaagtggtcactgataacaaagatcaagaaaatttgaataaatattttcagggtgaattcacgagactcccttggcttgacgaaatcactataagcaaattaaggaaacaacgggaaaataggacttggcctcagggcacctttgtcttaaacttagaatttccaatgttagagcttcctgttgtgttcatcgaaagggaaattatgaatactcaaatgaatattccaactttgaagaacaatcctggactaagcacagacttacgagaaccgaataggaatgatcctcaaatcaaaatttctttgggggacaaatatcactccacattgaagttttacgatcctgaccaaccaaacaatgatccaatagaggaaaagtataggagattggaaagagcatctaaaaatgcaaacttggacaagcaagtgaagccggacattaaaaagagggactacttgaataaaatcatcaactacccccctggcactaaattaacagcacatgaaaagggttcaatatggaaatataggtattatttgatgaacaataaaaaagctcttacaaagttattacagagtacaaatttgagagaagaatcggaaagagtagaggttttagaactaatggactcatgggcagaaattgatatagacgacgcattagaactattaggctcaacttttaaaaacctttcagtgagatcgtacgccgtaaataggctgaagaaggcatcagacaaggagctggaattgtacttattacagttggtagaagctgtctgttttgagaacctgtccactttttccgacaaatctaacagtgaattcactattgtggatgccgtatcttcgcaaaagctttcgggtgattctatgttactatctacatcgcatgccaaccaaaaattattaaagtccatctcgagtgaatcggaaacttccgggacagaatcgctaccaatcgtcatttctcccttggctgagtttttgattaggagagcactggtcaacccaaggttaggaagttttttctattggtatttaaagtccgagtctgaggacaagccatatttagaccagattttaagttccttttggagtagactggataaaaaatctcggaatatactgaacgatcaagtcaggctaataaatgtgctcagggaatgttgtgaaacaattaagaggctgaaagatactacagccaaaaagatggaattactagtgcatttattggagacgaaagtcaggcctcttgtcaaagtacgaccaattgctttaccactagaccctgatgtgttgatatgcgacgtttgtcctgaaacttcgaaggtatttaaaagctctttatcgccactaaaaataacattcaaaacgaccttaaaccaaccatatcacttaatgtttaaggttggcgatgatttgagacaagatcaactggtagtacagatcataagtttaatgaatgagttattaaaaaatgaaaacgtggacttgaaattgacaccatacaaaattttggcaacaggaccacaagaaggtgccattgaatttatccctaatgacacattagctagcatactaagcaaatatcacggtattcttggctaccttaaactccactatcctgatgagaacgcgacattaggcgtacaaggctgggttttagataattttgtcaaatcttgtgctggctattgtgttattacatacatcttaggtgtcggcgataggcatttagacaacttactagtcacgccagatgggcacttttttcacgcagactttggttatatcttgggtcaggaccccaaaccttttccgccattaatgaaattgccccctcaaattatagaggcgtttgggggtgcagaatcatcaaattatgataaatttcgcagctactgttttgtggcatattcgattttaagaaggaatgcaggcttaatcttaaacctgtttgaattaatgaagacttcgaacatacctgatatcagaatagatcccaatggtgctatattacgtgtaagagagagatttaatttgaatatgtccgaagaagatgccacagtgcattttcagaatctaatcaatgatagtgtaaatgctttgctgcctatcgtgattgatcatttacataatctggcacaatactggcggacctgattggttgataattggtgcttcaaaatttaaatttcgtcactctaattatacttaacatataaatggtaccttcaatatatcttcttagtaaaaagtagcatgattttgtgttaatttgcactttttttatttaaaaataaaaatcacagttaatttttcatgatcttgcaaagacacgcctccccctaatgtggcatatataacaattgtgaatcagaaaaactcaacactttaacataatggcgggcacgaaggctaaacaaacaagattagcattgaatgccttttttgggtacaatagaacagtactgaatgacatcatatatcgaaaggctcaagtcggcagcatcgtatcttgatacagttccagatgagcatcatgatttcagaaaacccaccgccaaggttgtaacgacgcaactgactattgctacttcactaggtatttttgctttgctttcgttctcaattctactaaaaaagtggcctagattatacgcaagcagacgatataaagatgacgggaaccttcgcttaccgtcctggaatcagtcaagtttattcggctggttaacagtgttgtataagatacgggacgaacagattctggaatatgcaggtttagatgcgtatgtgtttttgagttttttcaaaatgtgcatcaaattactttctattttttgtttcttctctgtgtgcgttatatctccagtaagatatcattttactggaaaaattgatgacggcaacgatgatgatgacagtgaaagttctttaatacatctggtaaaaagaattgtggagggaagtggcgatggtgacaatcattcagctcccgaacgtacaaatgtgtacctctggatgtatgttctcttcacatatttcttcaccttcatagcaattaaaatggcagttgcggaaacaaagcacgtcgtaagtactaggcaagcttatcttgggaagcaaaatacgattactgatagaacgataaggctctcaggcatcccgatagagcttcgtgattcggaagccttaaagaccagaattgaacaattaaaaatcggcaccgtttcatcaatcactatttgtcgagagtggggtcctttgaacaagctatttcattgtcggaagaaaatactcaaaaacctggaattaaaatattcagaatgtccaagggagctccgtactcgacaaccatattcggagaactatcatttattgggaaacgagcaatcaggcgcagttacacatggagaaaatgttccatcaagcaataataatgacgaggatactatactatattctcaaatttctcttggagagagaccaaaaatgaaaattggatatcgtggtatctttgggaaggaagtagatgccatagagtacctggagcagcaattaaaatttattgatgctgaaattattgaagcgaggaaacaacactactccgcaacacctacggcattcgttacgatggattctgttgctaatgcgcaaatggcagctcaggcggtattagatcctagagtacattacttcataaccagattggctcctgcacctcacgatatcaagtgggatcatgtttgtctttctagaaaggaccggttaacaaaagtttattctactaccgtatttataggcctttcaagtttgtttttagtcattcctgtatcatacttagccacattgctaaatttgaaaacactttcgaaattctggccaagcgtagggcagctactaaaagatcaccagtgggccgctaacattgtaacggggctattaccaacctatctcttcacattgcttaactttggaatcccctatttttacgagtatttgacttcttatcaaggattggtatcatacagcgaagaggaaatctcacttgtttcaaaaaatttcttttatatttttgtcaaccttttcttagttttcacattggcaggtacagcatctaattactgggcgtacctcagcgataccaccaaaattgcttatcaacttgctacatctgtgaaggagttctccttattctatgtcgatttgattatattgcaaggtattggtatgttcccgtttaagttgttattagttggtagtttgatcggctttcctctagtgaaaatcaaggctaagacacctaggcaacggaatgaactttacaatccaccgatatttaactttggactacaattaccacagccaattctgattttgattataacgttgatctacagtgtaatgagcacgaaaattttgacttcagggctggcgtactttattattgggttttacgtctataaatatcaattgatttttgccacagatcatttgccccattctacaggaaaagtatggccattaatttttagaagaatcatcgttggattgctattgtttcaattaacaatgacaggaacactggcaggattcgaaggaggatgggttttgtcatcttgccttttcccgcttccagtagtgacattatgtttcctatatgatttcgagaagaactatttgccgttgtcaaaatatatcgcattgagttcaattcgcgagtacgaaagagacaattctacggtgaattctgccaatgaggaagagtcgtatgcatacccttacgctgtgagtgaattagagggtccgatgttggattgaaatcccaaggtgctatttctatatttatatattttgttgtgaaaatgccaaaataagatttttgatacaagtaatactggatatttttttatttgcttataacaataaataagttcctgacttctgtagtagtagtataaactcctgatgtattaaattcttaataactgaaaagttaaactttgccacgaaaactataagtattggcttaaccatgaaatatcgtaataaagacacacttataaaaatctttatgatattccaataggaaagattagttacaatcttcaacgattcaataatatagagattagctacccacttaatgatactcatcgaaattagagtatcataaggccatatcaacatcaatatcggaaaaattttggcaccgtacgataataagatcgtatatgatatgacatcctttgaagaaacggaatagtgcttccaatgcaactttttcagtatgaaatactgggtaaaggtgtggaataaagaaacgtcaagaatacaataacttgcaaagtaaagatattgtattggtgggctccaggtaaacactttacttgtaatggtattgcgcatgattgccgagtcccatttgaagctctctggtaatttttttgaaagcatgatgagcttaccatcattattgttacggttcaaatagtagatgtatttactctcctcagtaacccaagttaaataaatctcgaatgataatagtagaagccaaaggcgatttaaccggtcatatttacaaaaccagttctttacgttaaataacaaagcttgcgtatagtcacgcaaacactggcaatcatttagcgcttttcttttcggatattttgagagatgcaattccaaagcattgaataccaagtgtctatatgcacctgcttttaatagaagcaaatcaatgaataacaggacattatctatctcaacatatttgtctactgtctcttggcaatatggacaatctgtcagctgaatgtggtcattcgagtacactgtataaagggaatctacgggccgcatgcacgttatgcaaatcatcgtttatcacagctaatatctactttttgatgcgcttcatccgttcactgacgcaccaaaccttccttctatgcaatgacaagaatttctcagcttgatttatgccattgatgtttctgaatcatcaattgttcacatagggctattcaatttggcccgctgtccctaaactgaaaaaatactaagaaaaattttgcaaaaaatctaaaatgatgaggtgaaagatcaaaaaagaaagatcaataattaagaggttggcaagtcatcctgatcgtgaaaaaaacttaacaagtacaaatagagtaatcagcattggaaaatgtctcgcgttggtgtcatggtattaggacctgcaggtgcggggaaaagcacattttgtaattccattatatcacatatgcaaactgtaggacgaagagctcatattgtaaatttagaccctgccgcagaagctaccaagtatgaatttactattgacattagagatttaatttccttagatgatgtcatggaagaaatggatttgggccccaatggtgcgctaatatattgcttcgaatatcttttgaaaaatctagactggcttgacgaagagatcggggatttcaacgatgaatatttaatctttgactgtcccggtcaaattgaactctacacgcatatccctgtcttaccgaacatagtgcgccatttaactcaacaactgaatttcaacctttgcgccacatatcttttggaagcgccatttgtgatagatagctcaaaattttttagcggtgcactatctgctatgtctgcgatgattctattggaactaccccatatcaatgtgttgagcaaactagacttgataaaaggcgacatcaataagaaaaaactgaaaagatttttgaatcccgatgcaatgttattaatggaaacggaaggaatgaatcaagcatccaaccctaaatttctaagactgaaccagtgcatagccaacctcgtcgatgatttcggtatggttcaatttttacctttggaatctaataatcctgacagtatagaaaccatattatcgtatgtcgatgatataacacaatgggcagaaggacaagaacagaaagagcctaacgaccaaatagatgtcgaagaatagttatagagaaaattatgtacgcttgattcatataaaaagaggtaaaaaaaaaaaatagcttctcataataaccaattcggactcgggaaagtacaagttcaagttttttattggtttctatatgtataagataaaaatacctagatctatttaattctctgtcttgggccacctggtgatttcttattcctggctgttaggatttcaacaccatgttcggtaaccaacagtgtatgttcaaattgagcactcagtttaccgtcttgggtggtagaagtccagtcatcaggccaggtcatatccttccaagtaccttcattaatcataggttcgatggtgaaaaccatacctggtttcataacaccaggtgttctattcttggcgtagtggggaatatttggggaacaatggaaaaattcaccaacaccatgtccacaataagttcttactacactgcacttattttcggtagcgtgtttttcaatatgatcacctaactcttggaaggtggtacctggcttacacattttaatggctagtttcaaacattctcttgaggtctcagtagtattaagagcttccttagaaatgttttcgccgacataatatgtctcattcaagtctgcatgataaccttggtagtataaggaaacatctaaattgacaatatcaccttccttcaagacagttttatcgggcacaccgtgacaaataacttcattgacagaggtacaaagcgatttaggaaagttgtaataattaagaggggaagggtaggcacctctcttaattgtttcattgtggacgatttcatctaattcatctgtagtgatgcctggtctgacatgggcagcggcaatatcaagaacttctctacccaacatacatgcctttctaatcttcttaatttgatctttcttgtatatagggatgttgttaagtctatcatttctttgttcactgactggtagcccattagcggcccagtccggtttaggaatatcttcagggacataccttcttggggtaagtggatatgaagccttcactttaccagaatatttgaattttgggaaaggatcataagcaccttccaagccgtccttagcattgtgcaaagctttgtgagctttgtagttgttttcataacagcttgtgtcgcagaaaatggaaacgatgccttgttttagacaaacagggcatttcatttgggacgaagtttctctaccacattgcaaaccggagcaatatatcttggtaggatgagaagcctgatcggaggtagtaactgttgtagttgcagtgctcattatacaatttttttgcttatttttttcttgctaggaatatacacaatagcgttcttgggatgaataataataatatcagtttttcttctttatatgaaaaatgaaaaaaaaaaaaaataagtaaaaaattttcgctttcttttcggggagcagccaaataaagattgctgctagtttaaatgagatggaccaaaagccatgggcagcagttctcccattgtcatgactttagaacgagaacctgtggaattaagcatgactattggaaagtccttgaccacaaattcattgataaactgcctgcaaacgccgcaaggggaaacacactggtcctcagaatcgccacaaatgaccatgcatttccatcctgagcgatggcctgccattagaacttgtatcatagcagatcgttctgcacatatacaattactgtagcttgcattctcgacattagcaccagtgaagataacatcgttatttgttaatatggaacaaccgacacggaagtgagaataggggctataggagagttcacacgccttcagtgccgccctttttaaggcttccagttgtctgtcttctatgccacctactttcattaccttatttctctgcttgagattctctgtttggttttcctagtttcttgtacataaacagtttgtgtttattttgtcaaactactcggaaattggcgagcagcgccttatcaagattacagtttgcaaatataaaaatgtaaaggaaagaaagcgtaaggtaacaagaagagaaacggggaagataatggccttggtctctagaaggtcgacaagatcggaaagcacctcaataacaaaggaagagcatacaggagaaggttcattgacgaagttgttcttccgatggcttgttaccttggagggtgatcaggatataaacgatggaaaaggttatatatcgttaccgaatgtctcgaattatatattcttccttggtggcaggttcaggacagtaaagggcgccaaaccgttgtggttaggtgttctccttgctattgtatgtcccatggttctcttctccatatttgaggctcacaaattgtggcatacccaaaatggttataaagtgctggtcattttcttctattatttttgggtcataacgctagcatcctttatcagaacagccactagtgatcctggcgttcttccgagaaatattcatttaagtcaactaagaaataattatcagatcccgcaagaatattacaacttgataacactaccaacacattcttcaatttcaaaagacattactatcaagtattgtccatcatgtaggatatggagaccacctcggtcttctcactgttccacatgtaacgtctgcgtaatggttcatgaccaccattgcatatgggtcaataattgcataggaaaaaggaactaccggttctttttaatattcctgttaggtgcaatactttcgtccgtcatattattaactaattgtgccatccatattgcacgggaatcaggggggcctcgcgattgtcccgttgcaatattgttactttgctatgcagggctaaccttatggtatccggcaatactgtttacttatcacatatttatggcaggtaatcagcaaacaacaagggaatttttgaaaggtattggatcgaaaaaaaaccctgtattccatcgtgtggtcaaggaggaaaacatatataataaggggtcctttttgaaaaatatgggtcacttgatgttagaaccaaggggcccaagctttgtaagtgccagaaagccacatgaagctggagattggagatttatggatttatcgccagcacacagctttgaaaaaatacagaaaatataaggaagtatagatataaagaactcagcgacacagtagtacgtaaaatataaaaaggttactgaaaggagtgaattccgccatagtataggttgagtatacgcaaataaacgttggaaattggctagaatgttaaaaaaaacattcattaaaaggttcttttcgtataacttttacaacaaataagtggttgtttggccgagcggtctaaggcgcctgattcaagaaatatcttgaccgcagttaactgtgggaatactcaggtatcgtaagatgcaagagttcgaatctcttagcaaccattatttttgccttccgaaaattttgaagctacatattagcactcttcttcagatgtcagacaacgtgcagcatctttttttcctaccattgaatatatatatagtaattacggcaaccgtttatataaaaattcaaaagattaaatattttaatatattagtgtctggtttaaaagtcatacttctctaatcactaccgtgaaaaaagcagttccataagtgttcattactgacttcttggtctaccacgcttatctcaaacttcgcatcatcgctttcctcattatccgtttcatcttgtgcttcgtcgtatttatcgcctttttttgacttctcctttcttttgcgctcttcgagtatacatttatatctgaggatgttttcttcaacggtatttctgatcatgaaattccacacaaaagtttcttcatcttgtcctatacgattattccttcccatagcttgtaattcatcactattattaaggataggatctagtaggaaaatatgttttgcatttatcaaattcaggccggcacctaaagttttcacattcaaaagtaggcaagtgacggaaggctggcgtttgaagttatttatagtttcgccaacattggctgtattagatagacatgccaagtgttcaatgtgatacaactttaataccttaccaatgacctttaaatattctgtcttttgagagtatagaataacttgtggcggatcagcgttttcctgctcactttttagcctcaggtaagatattaacttgatgacgaaatcaatcttagcaccaaaactttcctttatgtgaatttgatggacttcattaatttgatggaattgctcgtatttatttccgaataatttttctacttcactcatattggatataatcgagttttcatttgaattatcttgagacgaatcggcgccctctcttcgtggctcttgaatttctttttccctcttctccgttgagttcttgaacttaaagttatagacttccgatatactacagaaacctttgcatatagggcatttactatgggctcgtagccacgtaaggatacaactcttgcaaaaataatgtccacacttaatgatagcacctatttcaacttctcccaaacagatagagcagctcaatatttgattatcgtttaatgtgtctttcaatctggacaaattttttaaatatatcagccgtgattcaatgttattgatttttgcatctagtgtaccgcccaatgacttattgatagttcttattagatggctgagttgtggagcactcaaagagtgcaaggacaccaatgaatcggaaatcctctgtaattgactataatattccgtcttggcattataaatcgatcccaggattttcaaagattctcttacctgtttattgtacttaaacaggcttttactttcaacttcgtactgaagtaagtagtcctcaaaattttgaatggtagattcactttcattgcttgaggatatccgtcttactatcctgctgttcttcagttcatcaaaaacagttcgtagaggtgttcctgaaatcaagcgcaagctgttcaataactgcttttgatattttgaaattattgaaccttccggtaccaaatgcttcggaattttaacttctgattctgaagttaaaatattgtccctattctgtaaaattatctccaagcaaccaagaagactgaatatcttatcttgactgtcaatcgatgttgaatattcttcattaccgataattttattagtgctatcatcgtcctctgtcctgtggacaggttcatagataataatgagtaactcatccaataactcgttgaagtttttagtttgttcattcaacccttctatcaacttactcaaagacttgaaacaacgagatactgctaaattagatgagtagtcatttttgtggtcaaattcaatattgattaatcgcaaaggtatattgctcgtcataggagcaaacttagttctggccattttaatagtcatatcaacttttctagcctcagaggagaggattgacttcctcaaaatttctgcattcgcataattttcttgttctaaaagtctattctcttcaatttcctctaactcattttttggaaaaacatcagaatacaccacttcttcagtcttctcttttcgatgcttgtcgtccgcctcttctagcttacgagtgcccaagttatagtaaacagaaccgaggaagaagtagcaatcatgcagtaaattcatcatagcacgtaatcctttcttcttcaggtggttggataacattccgtcattgttgtgattatcatggtttttagcaccatttatttctctatcgctttcgtcgcctgaagatgtttccttctcaccaaacctctcgtccatatgttcgtcctcatcttcactgaggtttaacgacttatcaaacggatcctcaacgttgaatttttggcgtatgtgtatcatcaaatcatctctgattttgataaatgattcaagggctttggccggagtattggaaatttcaagttcatactgtgcctgcttgatcgataaatggaatctctctctgtaatagccaattaaactgtcaaatgcatccattcgcatggatattaagatatcgtctatatttgaaattcttgacaagtgcccgtgaaggcgcttctgtcgggtacttaaaatttctggaaataatgcatggcaacatatatatcgcagcctagacaaccattcgtttaaaaaggcattgcttacacggggtgatccactgccatccgaattatagccactcaactctaaaaaattgttccaaagatttaaatagttgtcccactcgataggcgcaaactccaggggaatgatgaagttgtgttgccgcggaatatgaatctgagacgcaacattggctttcgaatgccttatgcaaagatcatacctgtaaaaaatgttcatacaatccttgatagaaaaccgaacgccctttaattggcatacaaaatcattactagtgtaatctttagcctcatttcttagtttaatttcttcttgaagtgtccgaataaagtctacctcatcacaaaatggatgcagctttaaataagacatgatcatcctaaagttgtaaatgttctgtattggagtcccggaaacaccccaagtgtgtattctatgaagtaaactcgtgcattttgcagaatatgttgatgaactacgtagcatttgaacttcatccagaatgattctataaaactgcatcaaagctaacggtgaagaatagtcatactttgggcttttcaaccttctcgatctgatactacggttaaactcagcatgatggacctccgtggcaataatgttatatgatgtaactataatatcgtattggcacaattgttgaacagcttcgtccacagttttgcaatctttcattatctcattatatcctctataggtataccattttaaggaatttgcgtgtaattcgatttcttcgagccattgttttaagatagcattgggacagataatcaaagtcgtctttgtcttcgtgattgttctattttcatcgtcaataaatgttgcctctgagtccttcaatttccttctatttaagagtattagtgataaaatttcaatagttttgcccaaccccatctcttctgctaacaccccctttgcacaaactgggtagtcgccgcttaacctttccttcctatattggttgtacaaatgtgcagcatcttctgtagttagaatatatcctgttaatttgttccataacaatgatggccctacctcgtcagggctgcgtgcaatgagctcgtaaccgtatgcatagtactcgttcataaaatctataagccctacttcgtcgatgactgtaggtgtatcactaagagaattaccatgcccttctttaattagcatccactcaacgctctctctttgaaatggtaagaggttaacttttaggtctggtatagattggggtaagaacggtttgatctttgatagcctatctttactatattccaagatttgagaaataaattgtttttgaatgaagtttgaatggatatggctgtgcttgtgatatcgctcaaattcgttctcgtccctattagagaacgtcaagtccagtatttggttagcctccacggaaaaccggttgaatttattatttaaaaacttcaacttcaaattaaaagataaaacccatgttaaagaggaatcattgtatcggaatacgactggagagcattcaaaatctttgtaggacaaagataattcgtgtatacgactttttagtaatttttcaggatcgttaacatttgaatttttttttcttctctttcttgatggtttgcgttctaaagatttacgattttctaactgatttcgtagggccctttcttggtttttatgagcacatatatccaagatcagcggaagttgtttgtcaacagcgatttttgaattgttctccattttaaatccaatttgaaataaggatacggaatctgacgacacaacaagtgttgcctcgttatcattttcacaaggtaagatctctatatcaacaataaatttaaataactgcctaccgttgttggaaagacttattcgctctggtatttcgatatttaccgaggcaacgttgattaattcttttccgttcttgctaactttttgagttacagtctcttgttcctgatttagcgctggcaatgctgctatcactgaatcaaaagaaccattttctaggaaaaagtcgcatttttcggcagtcacgttgtactcccttgctaatagcgcacctactgcagacatttaccgtcgaataagttggcctttcctggagttcattcctttagacagcgcctagaaagtggcaaatcaatacattcatcagccacatttcatcagctgtagatctggaaaagacgggtagcagttcgagtgttccgaaaaaggaaaaaacgagccttatccttggtcagagatgcgagcaggtaattccttgagctctcataggagtgaagctatcccagactccttggatgtccctgtatttgcggtcaagtttgttctttgactggttcgtcatttcgagctcacttaaaaacaggagttattcagctacatcttcaagctaataaaacatccgttgcgcaggcactctttttagtagttgccatttcctttattcttgaaagtacgaaggctgaaaaagagccactacgatccaaaaaatcaccgttagttttagtcgtccacgagtacgttggcataaagtctagtaatctttttactttatagcaatcaagagaaaaaaggaggataaagggacatttatttgttattgttttttgttctttttaaacttttttactggctaggtttaaggttataattataaatccagtgattaagaggaaacctcgtcaagaatcctagataatagtaatcagcgacagttatttcaacgaagtcaaactctatctctggggctttatctctcctattgacatctaactttttacaaacgcttactagaaaagacggatcggccaaagaaaaaaaaagagtgacatcgaaaaaattaaagaaaataaaatcccagatagttcatacgttatttgaagtacaaacatttaacgattggaaaagacgaaagtattgttaagagtactgcttatttagagaggatcaaacaaaatctcttcgatgcttaaaataaaggcccttttctcgaaaaagaaaccggatcaggcagatttgtctcaggaatctaaaaaaccattcaagggtaagaccaggtcaagcggtacaaataacaaagatgtttcccagattacttcttcccctaagaaaagctttcaggacaaaaatatagttcagtacccgagtgttgtcgcagatgaccatcatatgaagtctttaaccgatgaattagtaaccacgatagactcggactcttcaccgagtgataatattaccacggaaaatgtggaaacagttacttccgtgccagctatcgatgtccatgaaagtagtgaaggtcaattaagttccgaccccttaatatctgacgaatctctttcggaacaaagcgagattatcagtgatatccaggatgacagtactgatgatgacaatatggaagatgaaattccggaaaaatccttcctcgaacaaaaggaattgataggttacaagctgatcaataaaatcggtgaaggtgctttttcaaaagtctttagagccatacctgctaaaaatagttctaatgaatttttaactaaaaactataaagctgttgccattaaagttatcaaaaaggcagatttatcctcgattaatggtgatcatcgtaagaaggacaaagggaaggacagcactaaaacttcttccagagatcaagtcttgaaggaagttgcactacataagacggtttccgctggttgttcacaaattgtcgcgttcatagacttccaagaaacagatagctattattatattattcaagagttactaaccggtggggaaatcttcggcgaaattgttaggttgacctatttcagtgaagatttatcaaggcatgtaatcaaacaattagcactggctgttaaacatatgcattcactaggtgtagtgcatcgtgatataaaacctgagaatcttctttttgaaccgattgaattcacacgctctataaaaccaaaattgaggaaatcggatgatccgcaaacaaaggcagacgagggaattttcacaccaggagttggtggtggtggaattggtatagtaaaactagctgattttggtttgtctaaacaaatattttccaagaacaccaagactccttgtggtacagtcggttacactgcccctgaagttgtcaaagatgagcattattctatgaaagtggatatgtgggggattggttgcgttttgtacacaatgttatgtgggttcccgccattctatgatgagaaaattgacactttaactgaaaaaatatcaaggggtgagtatacctttctgaaaccttggtgggatgaaatcagcgccggtgccaagaatgccgtggctaagctattagaactagagccgtctaaaagatacgacattgaccagtttttggacgacccatggttaaatacattcgattgtttaccaaaggagggcgaatcttcacaaaagaaagcaggtacttccgaaagacgccatccgcataagaaacaattccaactatttcaaagagactcctcgctactgttttcaccagctgctgttgctatgcgtgacgcctttgatattggtaatgctgtgaaacgtaccgaagaagaccgtatgggaacacgtggaggattaggctcgcttgctgaggacgaagaattggaagatagttacagtggcgcccaaggcgatgaacagctggaacaaaatatgttccaattaacgctggatacgtccacgattctgcaaagaagaaaaaaagttcaagaaaatgacgtagggcctacaattccaataagcgccactatcagggaatagcaactttcccttctgtttcaatctttttacctattcctttttaaaagatatatatacattaaactccttctacaagtatatattttatacatatctacagggcgtatatatacataacattttaagataagcaagtgaatgttgattcccgtttcttagtcaacacttctttctattttacccggtcgttaccctattaaaaaaacaacttacaatcattgttcgccccttccatacttactgccactcgcaaaagggcccaaccagggcaattacgtatcaaaaaatcatgacaggctgggtaataaatattcgtgaagaaagaagaaattaaaaaaagaaacgaagaagcaaaaaaaagaaaagactccgtttaatcactttcaaccgcggtttatccggccccacccatgcataaccctaaattattagatcacttagcacgtgaaaaagaaacgtttttaatgttttttttttttttttttttttttttttttttgtttnnnnnnnnnnnnnnnnnnnnnnnnnnnnnnnnngaaaattttttcgcttcctcgagtataattatctcatctcatctttcatataagataagaagttttataaaaaccttttgcatcaaaattttgtagaatatctctttttcttacgctctctttctttccttaattgttttctaaagaaccgtgtatttttctagttcgaatccatcgataacattaaaagatgtctgattcccagcaatccattaaggttctagaagaactattccagaagttatctgttgccactgctgacaacagacacgaaatcgcttctgaagtcgcttctttcttgaatggtaacatcattgaacatgatgttccagaacacttcttcggtgaattggccaagggtatcaaggacaagaagaccgctgctaacgccatgcaagctgttgctcacattgctaaccaatctaacttgtctccatctgttgaaccatacatcgtccaattggttccagctatctgtaccaacgcaggtaacaaggacaaagaaattcaatctgttgcttccgaaactttgatttccatcgttaacgctgttaacccagttgccatcaaagctttgttgccacatttgactaacgctattgtcgaaactaacaaatggcaagaaaagattgctattttggcagctatctctgctatggtcgatgctgctaaggatcaagttgccctaagaatgccagaattgattccagtcttgtctgaaaccatgtgggacaccaagaaggaagtcaaggctgctgctactgccgccatgaccaaggctaccgaaactgttgacaacaaggatattgaacgtttcattccaagtttgattcaatgtattgctgacccaactgaagttccagaaaccgttcatttgttaggtgctactactttcgttgctgaagttactccagctactttgtccatcatggtcccattgttgtccagaggtttgaacgaaagagaaaccggtatcaagcgtaagtctgctgttattattgacaacatgtgtaagttggtcgaagacccacaagttattgctcctttcttgggtaaattgttgccaggtttgaagagtaactttgctaccattgctgacccagaagccagagaagttactttgagagctttgaagactttgagaagagttggtaacgttggtgaagacgatgctattccagaagtttctcacgctggtgacgtttctactactttgcaagtcgttaacgaattgttgaaggacgaaaccgttgctccaagatttaagattgtcgtcgagtacattgccgccattggtgctgatttgatcgatgaaagaatcattgaccaacaagcttggttcacccacatcaccccatacatgactatcttcttgcacgaaaagaaggccaaggacatcttggacgaattcagaaagagagctgtcgacaacattccagttggtccaaacttcgacgacgaagaagacgaaggtgaagacttatgtaactgtgaattctctttggcttatggtgctaaaatcttgttgaacaagacccaattaagattgaagagagccagaagatatggtatctgtggtccaaacggttgtggtaagtccactttaatgagagctattgccaacggtcaagttgatggtttcccaacccaagaagaatgtagaaccgtctacgtcgaacacgacattgatggtactcactctgacacttccgtcttggatttcgttttcgaatctggtgttggtactaaagaagctatcaaggacaaattgattgaattcggtttcaccgatgaaatgattgctatgccaatctctgctttgtctggtggttggaagatgaagttggctctagctagagctgtgttgagaaatgctgatatcttgttgttagatgaaccaactaaccatttggataccgtcaacgttgcttggttagttaactacttgaacacctgtggtatcacttctatcactatttctcacgactccgttttcttagataacgtctgtgaatatattattaactacgaaggtttgaagttgagaaagtacaagggtaactttaccgaattcgttaagaagtgtccagctgctaaggcttacgaagaattatccaacactgatttggaattcaagttcccagaaccaggttacttggaaggtgttaagactaagcaaaaggctattgtcaaggttaccaacatggaattccaatatccaggtacctctaagccacaaatcactgacattaacttccaatgttctttgtcttccagaattgctgtcattggtccaaatggtgctggtaagtctactttgattaacgtcttgactggtgaactattaccaacctctggtgaagtctacacccacgaaaattgtcgtatcgcttacattaagcaacacgcttttgctcatatcgaatctcatttggacaagactccatctgaatatatccaatggagattccaaaccggtgaagatagagaaaccatggacagagctaacagacaaatcaacgaaaacgatgctgaagctatgaacaagatcttcaagattgaaggtacccctagaagaattgccggtatccactccagaagaaagttcaagaacacttacgaatatgaatgttctttcttattgggtgaaaacattggtatgaaatctgaaagatgggttccaatgatgtccgtcgacaacgcttggattccaagaggtgaattggttgaatctcactctaagatggttgctgaagttgatatgaaggaagctttggcttctggtcaattccgtccattaaccagaaaagaaattgaagaacattgttccatgttgggtttggacccagaaattgtttctcactccagaattagaggtttgtctggtggtcaaaaggttaagttggtcttagctgccggtacatggcaaagacctcacttgattgtcttagatgaacctaccaactatctggacagagattctttgggtgctttgtctaaggctttgaaggaatttgaaggtggtgttattatcattactcactctgctgaattcacaaagaacttgactgaagaagtctgggccgtcaaggacggtagaatgactccatctggtcacaactgggttagtggtcaaggtgctggtccaagaatcgaaaagaaggaagacgaagaagataaattcgatgctatgggtaacaagattgccggtggtaagaagaagaagaagttgtcttctgcggaattgagaaagaagaagaaggaaagaatgaagaagaagaaggaattgggtgatgcttacgtttcttctgacgaagaattctaatctttttgatcactgctttcacagttttctttaagatttttattgatcaataatttatgtatattttaatttctatgtttttgtaatattgtttattttggtaaaatatagacgcaacttccttattataaagaaaggcattatttaaaagaaaaagcgttccattagtcagacatctttttttttcatacattcttaagctcaggcaaattgagcattgcctcatacccttttcggtaagagggtaacgaaaatatttttttggaagaataaaaataggtgacggatcatagactaggaagctttaaaacatgattgagcgtaatattatattccttctagaaaagataaaagagccaagacctaaaattttttcatccctgttctattaaaattgtggaaatgaggtttttgaggggatttgtattttctttggctttcactctatataaagtaactgccacggcagaaataggatctgaaattaatgtggaaaatgaggcaccacctgatggtttatcctgggaggagtggcatatggaccatgagcatcagctaaaagattacactccagagactttcttcgcgttacatgatatcaagaagaaaggatttttagatgaaaacgatattctatctctctacgggttgaaccgtgaagaaattgtgggggctggtgatggtatgggacaacacgatgaatctgagaaaattgacaatgaaatggctaagcgtgttgttagccttattatgaggttattggatgttgatgataataccaaaatcaccaaggaggaatatctacaatttgctaagagaggaaacaagttccctgaccttggcgttggtgtaggtcaccactccgattttgagctagaatatgaaattcatcactggaataagtttcataaggacaaagatccagacgttaaagtcgttcacaaagaagacatagaacatgaattgcttcatcatgaacatgaaattgaacatgaagaagaaattcaaagaggcgcttctagagctactgtaataactgatgacgaactagagtctagaatagagctgaaaaatattcccgagaaattcaaaaatggaattttttaatggacttggtcaagatgaatagttgagactgagaaaatattcaagacactatgtatgtagtcaattagcatgtagtaagtaatcaaagcacttaaaatatatttttaccatcgcatcgttgtgatgcctctcctttgtgattaactatctactttaaacgttctattttctatgttctaattacgtatgtattggtcttttctctccgatggtaacaagaagcgtttcgggaaacagtggcacctccttgtcccttaaatgtcgaactttaacagtataagtacaaagtgaaaaaaaaaaaaaaatggaaatatctatgatagtgatatgatagaagagctatttgaatgctatgttgtcatatttagccttacaaaagggaaaaggcaaacacagtcttttgttattactataggaaagatagaattgatattaaaacagtatgaagttattgcatttatatgaagcgagcttgaagagaaggcccaaaactacgaatgcgataatgacaggtgcgctatttggaattggtgatgtttctgctcaattgttgtttccaacatccaaagtaaacaagggttatgattataaaaggacagctagggctgtcatctatggttctttaattttctcctttataggtgacaagtggtacaagatcttgaacaacaagatttatatgcgtaacagacctcagtaccactggtctaatatggttttacgggtagctgtcgatcaattggcgtttgcgccgctaggtttgccattttatttcacctgtatgtccatcatggaaggtagatcatttgacgtagctaagttgaaaataaaagagcaatggtggcctacacttttgactaattgggcagtttggccacttttccaagcgattaacttttctgttgttcctttacaacataggttactagctgttaatgtcgttgcaatattttggaacacttacttatcttataaaaactcaaaggttatggagaaagacaaggtacctgttcattatccacccgtggtcgaataactggataagaaatcctgattttgaaaatatttggaattcaactagcatatttatcagaccttgttccttggggtactggaacagcatatacctaatagactttcggcagagagcagaccaacttcataaatatttgagtcaccaaagttggctagcaatctgcttttcctttacagatgtgcttggtcaggaacaatttatttaattacattcgtacttcttttatagaggaaatagtagctaacatttcactattgcggtcatgcctgttgttcttcagctaccgtttatgcaaaggtgtttaattaggtgtgagacttaagtgggccttttagtaccactgtgggttctggacctttatataatatttcattttttcaaaggttttttcatatgccgttaaaagaggtcaaaacatagacccgaggaacatatcttgtaaatcgctgcgttatgtatgcatattgtactcctaccttcgtaactggaaagaatcagtctgaaagtttattgagcctgaaacggagcaagattatagttgaatgtttcttattcggtgttgatagtagatgatgaccaaagctttttttaacaaactaccgtttgaggtattccgtcggtacgttaggacaggtaaaagcatccctcaaagaagccccaggacaagaaaatctcttctggtgggtgggactattgcatcagcagtagttttgtacaactttaatgacacttttcatgattctgtaaagcacacggcactgacgactaaaagaatcgctgtcgtcacacaagctaccactcgttgcttctaccattacaagagggctctaaataaaagctatgagaacaaaaaagaacgagaagttgccttaaataaatgtcataagatgtgtgccttaatcacgttgcatgcgctacgatcgaatggtgggatatatatcaaattaggccagcacattggggccatgacctacctgttgcctaaagaatggacggatacaatgataccgttgcaagaccactgtcccgaatccacctacgaagaaattgatgagttatttaaagaagatctaggcaccagcattgaggatatgtttttagaattcaacaaaaccccgataggtgtagcttccttggcacaggttcatgtggcaaaactaaaaaatagtgacggtaaaggttctagtgtagctgtcaaatgtcagcatccatcgttgaaggagtttataccattagatgttatgctgacaagaacagtgtttgaactgctggatgtcttcttccctgattatccgttaacgtggcttggtgatgagcttcagtcttcaatctacgtggaactgaattttaccaaagaagctgaaaatgcagaaaaaacccgtcattattttagtaagttcaagaagcaaacagcattgaaaatacccaaggtcattgaaagccacaaaagaattttgattatggaatatgttggaggcaaaaggttggatgatttggagtacattgacagtcacggtatctcgcgcagtgaagtttcgagttgtctctctcatattttcaataacatgatttttactcccaatgtaggtattcattgtgatcctcatggaggaaatctggccatacgatctgttaagcccgctaaagataatggataccataactttgaaattgttttatttgaccacggactctatagatatcctagcacgagaacaagaagactttatgccaaattttggttgtcgctcctattcgacaaggaccagacaaaaatgaagaagtatgccaaaggattcgcaaacatcaccgacgaacagtttccccttttagcggctgcaattacgggccgtagcattgatgctgctttgaattacgacatttcaacgagtcgaacacaagaagaaatggacgtcatggcaaatgggatcttggaaggaacgttactgagcgacttgatgagcattttgtctagaatccctcgtgtagtgcttttgatattgaagactaacgacctaaccagacatcttgatgaatgtctacagaatccactcgggccagagaggactttcctgatcatgacgcaatactgcgccaagacggtctacgacgaaaaagtggaaagaattaattcggagtatgcgaggtggtctattaaatggatgtgggagaacttgacaaactggatagtctatgagaggcgtattaatcaattgtatttttatgattttgtgttgtggtggaaaaaatttattccgaagacttggttgtcatcttaaatcgttagcgttctttctacttgtaaatatatacgtaaaattatatataacaattttatatgtgtcattaaacggaagacgttgttgctatcacagtggattgtgttatttgggtatttggaatattacagtgacttcttgcagcgttgttagtttttgccatgttctgcaagtacaaggttgaagatgtggtcgagactttgatagtatccttaaacaacttcatttttttattttgactgggtaacgacctggtgttccttctagtctcaccgctagtggcttcttctttgctgactcttaacttttgcagcgcctctttggtgtcgagtaactcgtgttccagtagaacgttgcgttccagtcgtcggtcactctccaattgtaatgtctctatcttattcctcagttggatattttcattttccaactcatctacctgtatctctaaatctgttatctgtttcttattgcacttattttgttgttggctctcaagaagatcgctttttaactttgatattacttgttccaaatcattttcatattctttcgtggcgccttcaagctcgctcaactgggtctccagtgaggagattatctgtatagctgtttccaaatccaaattcggcaccataggaaagtcgcaattgttgcacgtatatgtcccttggatattccaattaaatttgcgaggattgttctttcggccgttcgtggtttgttgtagcccttattatccctctttttcatccttaattgcaaatttatgtatgaaaactttcatttctaatgttattaattttcccgattctgcaaactaattgataaaataattgatacttgccgtcacagatgatatagagaacgttcagtttttttattgttctattgtaaaaaaaaaaaaaaagaagaaaaaagcaagatccgataaggagaagacctctttagcggctttactgcgctacaaataaggttacgaatatgcggaatagttcatgatacgttgttgagttatagtatgtagccaatatttcctgtttttccgctgttacccttttcgaaggatcgatgaacgcttctgtcacttagtaagcaaatgtacgaaacccagagcattgtatgtacaccagcagtcgttttttgtagctcttttccatggatggacgatgatggcaagacgcgatcgtggcggagcctcactaagaaaaacaattgtggagaatctatacacacagaaatcgtacttcaagaaatattgattagcgagcctttaagcacagaacaatctctatagccaacatcttgtggaagctacaactgtttttcttgttcccgcttgagtagggccttacaaggcaagaccgtataaaataaagataactcctccgccgtatcctgaatttcgtgtgccctttctctctctctctcttcctctttcttcctttccctttccctcttcttcttatctcaacaaccgcccagcgcattagcaaaccacagtacgagctgtacggctgagccactgcacctgtctggcttgcccctttttgttgagtaaccgggtaataattcggctgtctaaacgatacaatcctcgttccacccacacccattcacccgtcgggcgaaatccaccctcgcggcctcgtttagaataccaggcaacggcaccagcaacggccccggtaactcgatcgcgttcatatatatcggatatactcttgaggcacaatttttttcggttttcggttttttctattattcttcgagatgcaaagcacacatttgagactcacaactcaagataccgcaagcacacagacgctattgttctcccaaagaataggttcctgcagtgctcttttaaggtttgaagatattgcacaaaattgtatctgatttcatctcatcgaacctcattccatcaacttccttttatcaaagcatcttgttttgttttcgcagaaaatttttcttccctttcaatttggccttttagtttttctccagtcgcaggcaagaaggtaaggaaatagaagaaaaagaaaaaaaaaaaaagggaacaataggttagatgtcgaataccccttataattcatctgtgccttccattgcatccatgacccagtcttcggtctcaagaagtcctaacatgcatacagcaactacgcccggtgccaacaccagctctaactctccacccttgcacatgtcttcagattcgtccaagatcaagaggaagcgtaacagaattccgctcagttgcaccatttgtcggaaaaggaaagtcaaatgtgacaaactcagaccacactgccagcagtgcactaaaactggggtagcccatctctgccactacatggaacagacctgggcagaagaggcagagaaagaattgctgaaggacaacgaattaaagaagcttagggagcgcgtaaaatctttagaaaagactctttctaaggtgcactcttctccttcgtctaactccttgaaaagttacaacactcccgagagcagcaacctgtttatgggtagcgatgaacacaccacccttgttaatgcaaatacaggctctgcttcctctgcctcgcatatgcatcagcaacaacagcaacagcagcaacaggaacaacaacaagacttttccagaagtgcgaacgccaacgcgaattcctcgtccctttctatctcaaataaatatgacaacgatgagctggacttaactaaggactttgatcttttgcatatcaaaagtaacggaaccatccacttaggtgccacccactggttgtctatcatgaaaggtgacccgtacctaaaacttttgtggggtcatatcttcgctatgagggaaaagttaaatgaatggtactaccaaaaaaattcgtactctaagctgaagtcaagcaaatgtcccatcaatcacgcgcaagcgccgccttctgccgctgccgccgctaccagaaaatgtcctgttgatcactccgcgttttcgtctggcatggtggccccaaaggaggagactcctcttcctaggaaatgtccagttgaccacaccatgttctcttcgggaatgattcctcccagagaggacacttcgtcccagaagaggtgtcccgttgaccacaccatgtattccgcaggaatgatgccgcccaaggacgagacaccttccccattttccactaaagctatgatagaccataacaagcatacaatgaatccgcctcagtcaaaatgtcctgtggaccatagaaactatatgaaggattatccctctgacatggcaaattcttcttcgaacccggcaagtcgttgccccattgaccattcaagcatgaaaaatacagcggccttaccagcttcaacgcacaataccatcccacaccaccaaccacagtccggatctcatgctcgttcgcatcccgcacaaagcaggaaacatgattcctacatgacagaatctgaagtcctcgcaacactttgtgagatgttgccaccaaagcgcgtcatcgcattattcatcgagaaattcttcaaacatttataccctgccattccaatcttagatgaacagaatttcaaaaatcacgtgaatcaaatgctttcgttgtcttcgatgaatcccacagttaacaactttggtatgagcatgccatcttcatctacactagagaaccaacccataacacaaatcaatcttccaaaactttccgattcttgtaacttaggtattctgataataatcttgagattgacatggctatccataccttctaattcctgcgaagtcgacctgggagaagaaagtggctcatttttagtgcccaacgaatctagcaatatgtctgcatctgcattgacctcgatggctaaagaagaatcacttctgctaaagcatgagacaccggtcgaggcactggagctatgtcaaaaatacttgattaaattcgatgaactttctagtatttccaataacaacgttaatttaaccacggtgcagtttgccattttttacaacttctatatgaaaagtgcctctaatgatttgactaccttgacaaataccaacaacactggcatggccaatcctggtcacgattccgagtctcaccagatcctattgtccaatattactcaaatggcctttagttgtgggttacacagagaccctgataattttcctcaattaaacgctaccattccagcaaccagccaggacgtgtctaacaacgggagcaaaaaggcaaaccctagcaccaatccaactttgaataacaacatgtctgctgccactaccaacagtagtagcagatctggcagtgctgattcaagaagtggttctaaccctgtgaacaagaaggaaaatcaggttagtatcgaaagatttaaacacacttggaggaaaatttggtattacattgttagcatggatgttaaccaatctctttccctggggagccctcgactactaagaaatctgagggatttcagcgatacaaagctaccaagtgcgtcaaggattgattatgtccgcgatatcaaagagttaatcattgtgaagaattttactctttttttccaaattgatttgtgtattattgctgtactaaatcacattttgaatgtttctttagcaagaagcgtgagaaaatttgaactggattcattgattaatttattgaaaaatctaacctatggtactgagaatgtcaatgatgtagtgagctccttgatcaacaaagggttattaccaacttcggaaggtggttctgtagattcaaataatgatgaaatttacggtctaccgaaactacccgatattctaaaccatggtcaacataaccaaaacttgtatgctgatggaagaaatacttctagtagtgatatagataagaaattggaccttcctcatgaatctacaacgagagctctattcttttccaagcatatgacaattagaatgttgctgtacttattgaactacattttgtttactcattatgaaccaatgggcagtgaagatcctggtactaatatcctagctaaggagtacgctcaagaggcattaaattttgccatggatggctacagaaactgcatgattttcttcaacaatatcagaaacaccaattcactattcgattacatgaatgttatcttgtcttacccttgtttggacattggacatcgttctttacaatttatcgtttgtttgatcctgagagctaaatgtggcccattgactggtatgcgtgaatcatcgatcattactaatggtacatcaagtggatttaatagttcggtagaagatgaggacgtcaaagttaaacaagaatcttctgatgaattgaaaaaagacgatttcatgaaagatgtaaatttggattcaggcgattcattagcagagattctaatgtcaagaatgctgctatttcaaaaactaacaaaacaactatcaaagaagtacaactacgctattcgtatgaacaagtccactggattctttgtctctttactaaatacaccttcaaagaaaccagactcgaaatcgggtggtagttcattcatgttgggtaattggaaacatccaaaggtttcaaacatgagcggatttcttgctggtgacaaagaccaattacagaaatgccccgtgtaccaagatgcgctggggtttgttagtccaaccggtgctaatgaaggttctgctccgatgcaaggcatgtccttacagggctctactgctaggatgggagggacccagttgccaccaattagatcatacaaacctatcacgtacacaagtagtaatctacgtcgtatgaatgaaacgggtgaggcagaagctaagagaagaagatttaatgacggctatattgataataatagtaacaacgatatacctagaggaatcagcccaaaaccttcaaatgggctatcatcggtgcagccactattatcgtcattttccatgaaccagctatacgggggtaccattccaacggttccatcgttaaccaacattacttcacaaatgggagctttaccatctttagataggatcaccactaatcaaataaatttgccagacccatctagagatgaagcatttgacaactccatcaagcaaatgacgcctatgacaagtgcattcatgaatgctaatactacaattccaagttcaactttaaacgggaatatgaacatgaatggagctggaactgcgaatacagatacaagtgccaacggcagtgctttttcgacactgacaagcccaccaaggctcagacttagcatccaattctgctacacagtataaacctgacttagaagactttttgatgcaaaattctaactttaatgggctaatgataaatccttccagtctggtagaagttgttggtggatacaacgatcctaataatcttggaagaaatgacgcggttgattttctacccgttgataatgttgaaattgatggactagtagatttttatagagcagattttccaatatgggagtgatgcggtttgtttatgtataaatagaaagggacatatttttattattattattttagttatttagcatgtatgttattttatcggtgaattgtaatgatcaaataataattggaggttgaaaaagttgcaaaaaatatttacttggacgagtccggaatcgaaccggagacctctcccatgctaagggagcgcgctaccgactacgccacacgcccaattttcttgttgtccgttgcgtttcagaatgggatacgtcaatatgataataatcatcctaaacgttcttaaattacatatgaaacaaccttatagcaaaacgaacagaatgagcaacatgagatgaaactccgcctccttaactgaactttccaaacgtataaacgcctgaacaattagtttagatccgagattccgcgcttccaccatcaagtatgatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctgataatcccttttggcaactcgttacttccctaagactgtttatattaggattgtcaaggcaccccggtattgctcgagcccgtaatacaacagttgtctttcactgctctctatgttttgagacctccagttcaccacatatattcgatctttttcttactgttgaagcaagaatctgttggaatgaaggcctagtattgtctattgactaatattcatgttactagtatattatcatatacagtgtaagaagatgacataaagattgagaaccagtcatcagactaatgaaagctgaaatgcaaggactgataatgtaatgggataatgaaatatataaaacggaaggagaaataaccgtgatattattatgtagatttaccgactccacttggaggatttctctattctcgagggaaacttggtatattcgtacacctaatattatagctcttgataacaatgaaatttcaacaattattcactcaaccctcaagtgtatatcgccaagatcctaatcacccctctctggtggccttccctcattgtttttacacagaacaagaatccataaaatcaagatattgggaacaattcattgtcttaggaacaagtttttataatttagtttcattagcctattgtaacttcttgttttttttttattttggctggcaaaacaagaagtataaagaagttaccactgctataacgtatatcttaaatcaagtgggcaattcttcgaataaacttagaggcgctgaagaaagaaccgctcaattagttcgatcatacaaaatacagatattgcgctgtgtattatcattacagaaagtgtgatataaacaatgctgtgttgtattcggtcttttttttccgcctgcagattgtcgtttttgtttttttttctcgtgtagctgcagttatcatcgttttgcatgtctgttctgtcggtgaagccgatctcatggcacttcgctttgataccgtaaagaatcttcttcattaatacggcactgcaaggcgatatctatctctggggttaggactgataaataggtacttatcagttatcactagagacgaactgtttacgttttgaagctcgacagcaggggttcttaacgggcgtcggcctagacctcaccttgcgagaaatttttagttcatatccaggggatggtgaatggttggatctgacgaagccacggtaagggcaaggctttgcgcatgcactggccactatgcataccatatataaatagataatcaagcgtatagaaaacgacatgctaagttattttactcagtgttaggtctcttattatttgcgtctgaaaagatcttagctctgtctttgactctatcacttatttttaagaggttctctattcgtcagtgatagaaatagcattttgacccgcacgacattggttaataagagtacttttccacgtgtttcgattgcctttatttttagcatacttgaaaataatattatcgtgagatttaggtaaaatataccacatatcaagagaaagagaagtaagaatggttgacgctaggggtagtacgccatgtttaattggtgattctataagaaacgttaatgatggaaatagtctggatttccagtatactaatcagtttaatgaggaaagtgaggcttcgaggttactaacgccacaaacgagttccaatcacgccctaagcaagatgcagaaggatgatgatattcgagatagatcttatacatctgtagcggaattgaatcgtgagggtgctttgctgaccgacgaagttgatttggagaatgttgatgcttcgaaagttcgcagcaatagagacgacctagaggcagaggagaaaaggaaaaaactactcttgttgaaaaaaaagcaaagaaataaatccatcaactcggaaagtttttcctctccttctctgcgtgcttccaaatctaattcactgattacatcaactgatcctgtcgaagatcacatcagtaagtactcttcatcaggcacccctgaaaatattacaggtgaggcagacgacgaagacgaagacataattagaaactcttacgggcaaatgatcaaaaacaattccaacaggccacatttggcgaagggtgaatcgtaccagtccgcagaacaggaaatagatcatacggcgcctgaaaaatcagagaatagacaagaaagaagcggtagatcctttgatagacaaaaatcttcggctgagtttctaagatccttatcgaggtcaataagtcgtggacccacaaagaacaaaacggtttcgccctctaagggagaagactctagaatgtatagtaccagcaactactctatatcattagttgatttggagaacggacccaaaattatcccggaaactttagaagaagagcaggaggacgccgaaaaggagggtgttttgatggaagacgagggtaatgaagaatacaccaaagatttggaagaagcagctaacaaagctcaaccacagtagaatggaatattgaaactggagtgacttctgatgaagtttccaattatttatatgtatacattatttatttgtctatcattaaaatttctgtcaagtaatggctttttatgtttatttcatggatcacaaaatttgctggctttttagagtgaccgatgagttgcatgtacatatgtgcgaaataaaacaatacggtagtaaaacatgaatacttcgagaagtaaattcaagattgcaggcgtagcacaagaatgcccttccgcctgctagtgtgttgagcaaagcacgccatcactaatggaacccttacaaaatctcgcatggagcagcaaaccttaaatccattttctatcattcgttcctgaggacccggatatcgttttagagacaaaaatagatactgcaagaggaatagggatatctgcacatggggcctcgagcatggctcattttcgattttccggcacgatgctgacttagtactatcatgccaggcaggacaggccttatggggttcttgcagcttaccaattctgacactggactgcccctggattagcgaccctgcgaccccgcgactagactccctgaaaatggtaattggtgatgatatatgtgactgagttcagcctgggcatacaatgtttaacccttttggacatggaattaggccagcaaagagagcagctttccccgaaagcgtagtttttctccaggaacgcaattcacccctttctttcttatgcaagctcctcgtacatatataaaaatatatgagtatatatagtgcttctacagcataatcaatttaaggttccttgcctttcctttaatatgttagctatctctaaagcatcactgagaagtggtagtttttttgataactgtgattgaagttttgactacctcagagaaaaattttgaatgtcccgtgacctacaaaaccatttgttattcgagactgcgactgaggttgctaatagggttggtggtatttactccgtgctaaaatcgaaggctcccattacggttgcccagtataaagaccattaccacttgatagggcccttaaataaagccacttatcaaaatgaagttgatatactagattggaagaagcctgaggccttttccgatgaaatgaggccagtgcagcatgccctgcaaacaatggaatctagaggagttcattttgtttatgggaggtggctgattgaaggtgctccaaaagtaatactttttgacttggattctgtgagaggttattcgaatgaatggaagggtgatttatggtcattagtaggaattccctctcctgagaatgatttcgagacgaatgatgctatcctattggggtatacagtcgcttggtttctaggcgaagtggctcatctcgattcacaacacgcaattgttgcgcactttcacgaatggttggccggtgttgcgttaccattatgccgtaaaaggcgtatcgatgtagttaccattttcaccactcatgctactttattgggacggtatttatgcgcctccggcagtttcgatttttacaattgtttagaatctgttgatgttgatcacgaagctggcagatttggcatataccatcgttattgtatagagagagcggcggctcattctgcagacgtattcactacggtgtcacaaataactgcttttgaagcggaacatcttttgaaaagaaaaccagatgggattttgcctaatggactgaacgtcatcaaatttcaagcatttcatgagttccaaaatttgcatgctttgaaaaaagaaaaaatcaatgactttgtaagaggccattttcatggttgcttcgatttcgatctagacaacaccttgtacttttttattgctggtagatatgagtataaaaataagggtgctgacatgtttattgaggctctagcgcgtttgaactacagattaaaagtatctggatccaaaaaaactgtggtagcgtttattgtcatgcccgccaaaaataattccttcactgttgaagcattgaagggccaggctgaggtgagggcgttagaaaatactgtacacgaagtgactacttcaattggtaaaagaatattcgatcatgctatcaggtacccccacaatgggctgacgacggaattaccaaccgatttgggtgaattactaaagagttcggataaagttatgttaaagagacgtattttggctttgagaaggccggagggacagttacccccaatagttacacacaatatggtcgatgacgctaatgacctgattttaaataaaatcagacaagttcaattgttcaatagcccaagtgatcgtgttaaaatgatcttccatccagaatttttgaacgctaataatccgatccttggtttagattatgatgagttcgttcgtggttgccatttgggtgttttcccttcatactacgagccttggggttacacacctgcagaatgtacagtaatgggtgttccctccatcacgacaaatgtctctggcttcggttcctatatggaagacttgatcgaaaccaaccaagcaaaagattacggtatttatattgtggatcgtcgtttcaaggcacctgatgaatctgtggaacaattagttgactacatggaagaatttgtaaaaaagacaagaaggcaaagaattaatcaaagaaatagaactgaaagactgtccgacttactggactggaaaagaatgggtctcgaatacgtcaaggcaaggcagttagcattaagaagaggctatcctgatcagttcagagagctcgttggtgaagaactaaatgattccaacatggatgctctagcaggcggaaagaaattgaaagttgcaagaccgcttagtgtacctggctcaccaagagatttgagatcaaacagcacagtctacatgacccctggtgatttgggtactctgcaggaggttaataacgcggacgattatttttcattgggagtgaatcctgcagctgacgatgacgacgatggcccatatgctgatgacagttaaatcctatgaggatataaacagtattaaaaatatcttaccataaagacatacgacatttcgaggcgtttttgcttttcttttaactttcgttggcacaaactgaaatatatgtggaatgccctctgaaaatatactaggagttttaagcgatccaaacattttcttttctttttttctcttcctcctagcgaagtcctcttgcgttagctgtaaacaaaataagtcaatttcattaatgaaaagtgacattatggcggtagctctctctatctttgttcagttatcaacatatagtcatacttaaagatataatagctcatagtcatatatagttctttatacttgaaaaagtgattcctaaaaatctcaacttttttcacattgtatttacaagataataaaattattaccatatttaaacgaaagataaattttgaattaaggcggtcgttacatcatacctggcattcctggcataccacctggcataccaccagcaccagcagctgctggtggttctggggcatcaacaatggcaacttcggtagtagctaatagtgaggcaacaccagaagcatcaactaaaccggatctaaccactttaaatggatcgatgataccagtggctaacatgtcggtgtattctgacttagaggcatcgtaacccttggcaaaatcatcaccatattcatcaatcaatttgccgatgataactgaaccttcttcaccagcgttttcaatgatctgcttggctggtcttgtaatggcctttcttatgatatcgacacccaatttttgatcgaaattgtcgacaacaacttcatccaaaactctagatgccttcactaaggcagtaccaccacctggcaagataccttcctcaactgcagctctggtagcgttcaaagcatcatcgtaacggtccttcttttcaccaacttcaacttcagatgcaccaccgaccctgatgacagcaacacccccggacaatttggccaaacgctcttgcagtttctccttctcatatgaatttgtggtggtaatgtcgatggagcccttgatttgttcaattctctcttgaatagcttcctttggaccactaccgttcaggataacggtgtcttccttagtaacggtaatagagtcacaagaacccaagttttctatggtacattgttctggtttcaaatccaactcctcagtaaaaacagtaccgcccgtcaagactgcaatatcaccaattgtattctttctattatcaccgaaaccaggcgccttcacagcacaaaccttaacttgaccccttaacttgttcaaaatacaggccgcaagagcttcaccgtcaacatcttcagcaatgatcaacaaaggtcttctgctttgattggaaatttccaaagctggcaagatatcttgaatggaagaaattttcttttcactcaacaatagcaatggcttttcaaattccaccttgctcgactttggatcagtgatgaagtatggagaaataaaaccacgatcaaacctcataccttcagtaacctcaagttcatcttccaatgttctaccttctctgatagtgatgacaccttcttttccaaccttttccatagctgaagctagtaacttaccaacatgagagtccccattggcagaaatggttgctacttgagcaatttcctcagatgtggtaatttctttcttgttggcgctcaaaaattcaatcactttttcaactgcaacttgagaaccccttctcaaatccatagggttacaaccagcggcgacatttttgacggattctgtgaagatggctctacctaaaacagtagcagaagtagtaccgtcaccagcagcctcattggttttggaggcaacttcttgtagtaacttggcacccatattttcaaacttgtccttcaacacaatagatttggcaactgtaacaccatccttagtaatctttggaggaccgaaaggctgttcgattaaaacgtttctaccctttggacccaaagtagcagcaaccgcttcagctaaagtttcgacacccttaagaagggaggctcttccttctacaccgaatttcaattctttatgagaggagtaagcacgacgcaataaaggccttaaagtagcgcgactacgaacaacggatgatctcaacattttgaaaacttttttgcttatgatgttttctcgtgggaattttcttatattattcaaggaagtgcatgaagacgcaaccacgaccttacataatgaatgtaaaacttagtctccttcaatatatatacatgaatgtccgtctggattctgctccggacaaaacgaagcaaaattaaagtcaccctccccatttggttttctggaaaattccacaaggtccgtatatgatgacatatacagatgggcggctataaagtaagtttccagaggtaataccaggcaataaacagcttcaattgctcgtaacaccattgtatacctacaaaaacagtggaatagggatgagacataactggctggaatttcaactgtacttctttgcacaactagtcttggcgttctacttgatcattgcgcgaatggatgcactcacaataattcccaatagtataacaggaggaacatttggatgcattaggtatattattcatcttctttatcatcaaaattttctcttcctttatgttactatgttgctttcttttaatctatgtttttttccctttcagttgccaccgcttttctgcaagattcatagttagatttgcaaatcaaggtgttttcgggccttgttaaagccttcgcaggcgaagaagaaagggaacgtaagctgcgtgagccgaatctatttatacaaaaacaatcaaaaaagtataactacagcataaactgttgtatatacgtgttgcaaaagaggaaagaaaagaagagtaaaaggactcttgatattatctcgaaaaaaccacaaatagtgtaagatttaaacagtaagccaaaagagatgactttgaaaccttcaaagagacgtaagggcaggtctcgccattccaggaagaagcaaataacgtcagcgatactgactgaggaaggaataatgatcaaggcaaaaccatcaagtccttacacatacgcaaatagaatggcagataaacgaagtcgcagcagcattgacaacatcagtagaactagctttcaaagcaacagtgataacaacagtatatttgaaacggcttcactaattagctgtgttacctgtttaagcgatactgatacaatagacagatcggaaacatcgacaacggatacaagtaaagatgatctttctgctaatccaaaacttcattatccttcggtgaatggtcaattgccagcaaacaccgttatcccctatggacgaattctggatgccagatacattgaaaaggaacctctgcattattatgatgccaattcatcacccagttcacctttaagcagctcaatgagtaacattagtgaaaagtgtgatcttgatgaattagagtcctcccaaaaaaaagaaaggaagggcaactcgctatcgcgaggaagtaacagtagtagtagcctcctgacttccagatctccttttacgaaactagtagaggttatatttgctaggccaagacggcatgacgttgtacccaaaagggtttcattgtatattgactataaaccccattcatcttctcacttaaaagaagaagatgacttggttgaggagattttaaagagaagctacaaaaacactagaaggaacaaatccatatttgtgatcattaatccgtttggtggtaaaggtaaggcgaaaaaactgtttatgacaaaggcaaagccgttactattagcaagtcggtgttccatagaagtggtttatacaaaataccctggtcatgctatagagatcgcgcgggaaatggatattgacaaatatgacactattgcttgcgcttcgggagatggcattcctcatgaggtgatcaatgggttataccaaaggcctgatcatgtcaaagcattcaacaatatcgccattacagaaattccgtgcggatcaggtaacgcaatgagcgtatcctgccactggacaaacaatccttcgtactcaactttatgcttaattaaatcgatagagactagaattgatttgatgtgttgttcgcagccttcttatgcaagagagcacccaaagttatcatttttaagtcaaacatatggtctcattgcagaaactgacataaacactgaatttattagatggatgggacctgcaaggtttgaattgggtgtagccttcaatatcatacaaaaaaaaaaatatccttgtgagatatatgtaaagtatgctgccaaatcaaaaaacgagttaaaaaatcattacctggaacacaaaaataaagggtcgttagaattccagcatattactatgaacaaagataacgaggattgtgataattacaattacgaaaatgaatacgaaaccgaaaacgaagatgaagatgaagatgcggatgcggatgacgaagactcccacttgatatctcgtgatctggcagattctagtgctgatcgaattaaagaggaagatttcaaaataaaatatccattagatgaaggtatccctagtgactgggaaagattggatcctaatatttcgaacaacctaggtatcttctatacgggtaaaatgccatatgtggctgctgacactaaattctttccggcagcgcttccttcagatggaacaatggatatggttatcaccgatgcaagaacctcgttgacgaggatggcaccaatcctgctgggactagataagggttcccatgttttacaaccggaagtcttacactctaaaattttggcatacaagataataccaaagttagggaacggcttgttctctgtcgatggcgagaaatttcctctagagccccttcaagtcgaaattatgccacgcttatgcaagacgttactgagaaatggccgctatgtggacacagatttcgattctatgtgacactttacttaatcttttccttcgtactgaacaattaatcaaaaactagaatatgtcatttctatttcttctatatttttttttacgttgttgttgtttttgttgttgtttgataactttatacactccatacttctttataaaaagttttaataccattctttaatacaaccatgtttagtgagtactagctcctacacatcagatcgtcaagtacattatgattatgattattattaatattatcagtacaattattatgtgctggtagttcactaaaaaatatgacgcacacaaagacttctccttatgccctatagaactgaaatattagatgttaacactgacaagcgctttgttcctgctcctctgctgtagaaatatcaatgactcccggtttattttggtttgcactatttgcattttcgctatccaaaggagttgactcgctgttttgaaattcaggcagcgatttggcaatctttttgaataaagctttgacattatagcctgcctttgtggacgtttccataaagattttagcacccaatagttttgcttttttctctccctcttcggttgagatttgcctttcatctgataaatcacttttgttaccaacaatgcacaatataacattttcatcacctctttcatttttaacgtcttctatccatttatcaatatattcaaatgattttctcttcgtaatgtcgtaaacgataatagcaactctcgaatctctgatatatgaaggtattaatgatctaaatctttcctgacctgctgtatcccataactgtaatctaattgtcttatcatccaaatacatggtcttggaaagaaaatctataccaatcgtggcttggtaatgatcatcgaacgtatcatacataaatctagtgatcagcgatgtttttccaacaccctgttctcccaaaaaaacaattttgtactttgtcaatgatttcccggatctgctcattgttaatttcttctttgtttatcttttactgttcagaatcaacagcttcaaacacttcttttcacacaaccttaagtgcccaattgtgatattcttacatcatacatagtaacaatctatacatgggcaatattttcctccactaattgagttgtgctgaaagctttattacccggaaattattcggccatttttcactagaagttaataccagcactaacgaatagaagcatctattctactcaagatgcccggttcatgaatagggagaagtatttttcttattttcctttagccatctataaatatttatccttatgcctgtcaccacaatagaaaagggtacattatatatcagttgttttcgtacctctagagagacacgcaaggggctttatatacgaaacctccaaatttgctagatgtaaccattatacatagtaattacgattgtaaaacatcggaaagaacgatatatcttgcaaatagcttttctttggtaatatatgtatttacttaaaaaacgagaactagaaaatactgagtaaatttttattagacgttgttaaaggccttttatttcttaccagattttttgataccaccacccactaaaggtttaccacttttcatattagccatcaaagctttcttagcagcagcatcggccttttgcttctctttgaaggcaatgtcttcaggatctaagtcctgttgttgcttcttcttttgctttagaggcttcatcttaccaccttggcgactagacatgattgcttagggtttttcagttattcttctggttttgcaacttactgtgcgtggagcaatcaattacaggattttaaacatgaaattttttattttcctcgttcattttcgtcgcgggaaacttccagaagtatagatttactacaatttttatctcaggacagaaagaataaaccaaaaaagccaagacaagccaagccaagccgaggcgactggaggagcttttcatcaaattcaatgacaaatcacaacagttttccctgttagaaaaggcatgtgcactcacaattcatattttcatacagaagatatacattggatttcaggaaatatcaggtaaggtacgacaaaaacaatggcgtttgccaaccctttatgatgggtgatcttgtatcggcttaattgtgtgatctaaaaaggcaaagtaacgtattattggctggtttatataatttgaatatgactactttttcaacgttaaaaacgataaatacttgctcaaagggttcagcggctaaataaactacgatttcgcagcaggatcagatggattcaatcacatcattcgcaaaacattcacatcattcgtgaagcattaaaggtaataagaaaaatagaacaaagaatttttaagcacaggaccacaaagggacagcaaatacggtgataagaatggaaggtttgaagaaaaagatttttggtgtttgcctgaaaaatgacttagcacagactaggaatgaaacgaaaggaatccactatgggttaatgactttggaaacttctaaacaactggaggaatttctccatttgctagtaataaagagagaagtaattcaaaattttgagttgttatttcacatcataaatgttgccgttaaaatcaccgattcaaatcttccaagtgatgatatctggcatttcattttaaaattaagattttcttctgagattaatatagacgaagactccaaagttttaaattatttacttgagactggcatcgcaatggaaaatccagtcagttggaaatgcttggccgttattagcagcatcctcagcagtgtccctcaatccaaaaagattataactaacctgatcgagacagaacatgccaaaaagattggtcagttgtttgataatattcaagatttgcaacaaggaaattttctggtggaaattctctctaactgttttaagaaaagtgcttcaaattccaagaaagtggaaaaaatacctcagttatggcaaagcaggtctaagaacaaatttttctttgaaaatgaattttacccttttagcagcaaaaatgggagcttacaaacctgccaatttctgtgcaataatttcatgtcaactttatccttcacgggtattctaaggcaggtttcttatagcggatctgaaacattaaaaaatctccgtatatttaagaaaaaagacgatgaaaattcttacttcattcagtgcatttacaacaaaatctatctttggttagacgagaaagcccctttggaatttgaaagaaagaaaatcaggattaccaaaaacttaaaaaataaaattcaaattaaattgaggcaacctttccacgaatgtgtgagaactaccgctgataaaacagcactcttatttaacaaaacgagggggtttcagctcgaatttgaagacgagaaattaggtgaaactttttttcacaatgtcaacaatatacctaagattagtgaagtacaaaactttttagttttagactatattgaagaagaaccagagaatgaaggtgaagaagaagagcaaaccagaagggcagatgagcagaaagaggatgaagaggaagaatctctcgatgaattatccactcccatggtatatccaataaaatcatctatttcccataaccataacgaaaaggttcagttagtcactcccgaccgttctgtttccataagatctgatgaatgggatttaaagtcaaatactgaagacgaagaaggtaatgttcttacagacctgaaaataagcagcactaaggaaacaagaaggcaaacagactacgtccatattgattcagaagaccagtcaccagtagtatccgctcagatgagaaaaatgagaagagaatctacgaaaacactagaaatattgagacaagagttcaaagataaggatgtacaaaacaaagaagaccagtccgaacaaatacaaaacccgtttgtaaatacatcctcgttagttgtaggtaaatcctgtcttgttaatcctaaggaaaagcctaatattgatcaaacggtcgtcggaataaccgaattaaagtcaaattcttccattaagaaaagggatatcaacattctcgacactatatttgggcaacctccgtccaagaagcaaaaacaattccacaaaaaggagaaaaagaagcagcagaaaaagttgacaaactttaagcccattatcgatgtcccttcccaagataaacgaaaccttaggtcaaacgctccgacaaaacccaaatccataaaagtaagtaagctgcgtaccgataagaaagttacaggggaaaaatcaagcccagaaacaacggcagagaaagttgatgatcagactgtgcgtagcaacgatgaacaagcagtgagcagagcaactaaagaaaagcgctttccagatgtcaatgaaggcaaagaaattactaacgatgacgctaaagtatctctcgagtccaaaaaaaacaatgaaacttttgttgattcaagtgtagtagaaaaacatacccccccagacaaagactgtaacaattgtaacattacagatattttggaatctaccactgttatcgacttgcactcaccccatggattatctgctcctggtcagaatactttcacaaacaaactgcaagaacaaatttatagttcaataaatcatttttctaacgaattggtaagaaaaatttcgataataaaccaagagttaaacaagaaaatcttaaaagagttgtccgaaaaataccaaaaactattcgccgaattacaagataatttccagaatgataccaatgagatgcttaaattcatgggcgagatcaaagacatgatgaatctcccggaagatcagctagttcatgctattaggacaagaaaatttgataacaacaagagataaatagtatacatatacgcaattctttttagatttaagatggctaataaaagtaatataggcaagcttattcatgttcgaattttttttctcgcagagctagtactctggcaatcgacacttatttcgtacaaaatgatcacgcaacttttgacaattttttttttttcatctgttttccaggaaacttggatcttttttgctccatagcacttttggtcttcctcaattaaatatttctagatcccggtagttctccttctttgaccattaataaaaaataagcaaggcataaaagagcagcaaaaatggattctaagaccccagtcaccttagctaaagtcatcaaagttttaggccgtaccggttctcgtggtggtgttacccaagttcgtgttgagttcttggaagacacttcccgtaccattgtcagaaatgtcaagggtccagtcagagaaaacgacattttggtcttgatggaatctgaacgtgaagctcgtcgtttgcgttaaaagatatattaagaaatttagaattggtgctcttcaagcgttttttttttctatatttacaaacaacagcttattttttaatatttctcaaaaatgaagtccgaatgattattttaattgagtttagtgatgaaatcgattgcaaataatataaacgttggtaagctcatctaaacaatcgaaaggagggatagaaggcagtaagtgtttgtgctttggtcggtttttccattcggtgaattcatacatctcctttattaattttaatggattctttacaagggattttcggttgccaaaaacagagaacaaatgcgtagaaatactcaatgatgtcaatttttcaaaaaatgaattaaatgattgaagtcacttaatttttgtggttttttggaggtgggttgagtgtacaactcactataattgatgagatattcgacgaacttgttacttttttggattccagaatgtttactgaattttaagaattaattaatttgaggctaacctgtatggcatggaataacgaatcgacaagaagtctcttactataactttctttttttttggtgcatctatcgttaaatacaatttaaatattacattcatgtacttactcaatataataatctgattacttcatacaatagaagagaaagaaacagtctctaaaactgctgtcataacgcgtggtgttgtggttttgcttaattttttttagacccatgcaccagatattgatcccattttttttgtggctcttttgccaatcgctcttattaagtaagtttacatccgcggttatgttttgcgtctgaatttcatttacagtgatggcgagcttgcgcggctattttttatgcggtttatcatttagacactcagaagctgcagtgatgtaagatactgcttgaaactaccgttagattaataataaacaattagaactgtcctaatacatataaacttatatgctccctatcaatggcataacgttaccattcaataaattaacattatcaatgcgtcaacaaaggaatagaactatttgaaaggtccaaccttaatttttgacgtttaattgacttgccttagttttttattctcacctttccaaattttctttttttctgtgggtattcttcgaccaaagaagaacttgattttgttttttctggtgtagcctcagattcagaaaaattctccaggcgaagttgcgaactggtactactttctctagattttggcttgaaatctgtctttggtttaattttaccgcagctatttggtcgagcctcatttgtagggtctacttgcaattcaaaatcatcattataaaaatgattcaccgcaggaaatctgatgcgctctttttcgttaagttctccagattcttcaaaccgcgacacatcttgaaatttgtttctaaaagataataatgttttcaatgagtccgccagaaattcttgatgctggaattttcctttatgtagtaattttttgattatgtcatcgtctgtgcattgctgcagagattcatagttcttagaattttcaggagcccattgactgataactttactcccaccgtctaaatcacgaagagaaattaaaagaaaatctaagcatttttgcttttgattcaaaatatcccgttgtacatagtggtattgggtggaaaggtttaccaattttaataaaagcatacataaactttgcaaaatcatatagaacatatccttagtaacatgtgaaggtacgctatttatggaaattgtaatatccgcagatacatcgaaactaaaaaccaaatttgaatctaccaatccaatttggttaatttcttgaggagcttgtagaatgtccattagttttagtttaattagatttaatgatatactatccgtaaaaccttggctctggcattgctgtgataattgagtttgtgaaagtttgaaaacgtagggaactaagcgctccaaggaaactaaaacaatcattacaattgtggttggagatgacatcggtagaaataataggagacaatttccctcaccaataatttttttaatacaccattctgcatcacttagctgctgccctttcaactcagaatccatcacacatgtgtaagattaacctcctatctggccgttgttatggttattctccatagggtttccacttatatgacactattttgtgtttgcccgctgccaacactatcatccctttttgggacgaaaaaatccatgtaaaaaaatacatcaatcataaatacatttataaatcgaaatgatattgtttataaaatttctttttgtcaatggaccaaaggtctttggaaatctctttgaacgttttccaaacatcattaataaaatcttcaatcatgagatcactgaagtgctccatattaatgccctttttcagccaaattttttcagtctctattcttgcttgggacgctttatcgaataaaaccctacttacgcgttcaaacgccaaagttgaagttaactgataaaaattggaaactgcttttaacaatcgcttatttctttcattaacagcaaatatgctatcaacgatttcgtaaaatcttattattgttcctgaaaatgagagaaatttatcagtcctaacatcgaatcctgtcaaaagttcatcaaagttttcttcttcatatttaatgaattgtatttttttcccagtgtcaaggtcaataaggaaaaggaatcccttctccctgaagattaacctattaaatgctaaactgtacacttgcgatactattcgtattaaaagtggattgattagaataatagacagttttagcccttcagttaacacgttctcctggtcgttgataggctctttaaaatgaaataccattgtattaacacagactgatatggatatcaacaagaactgaaccattctgttcttatctatgattctgctttgttgagcgatgatcatctcaatattgtatatactagcaactatacttagagatcttgataaaatcaatatatcaaagggatcaatatcagagtagtaaactgaatttgtataatgttcgataggtgaaaagttagattgtataaattcaatcaatctcaatgaaaaagtggtcaatttttcgttcatctctctcttgtgaatttcacgagtagtgaatcgggaaacatctaaaaaatcgtgcattagcttaactctcctaaagtcaatactcggtgattggaaattctgcgcagtaaatatacttaaatcgaaaagatcatctgaaatagacggaggattacctatatcatatgaggtggatacatcaaggaataaagcccaaaaccaaatacacctcaagttttgtttggtttcctcactttcgttcaaataccatttatcaatatcatttaaacccaaacttatgcacccctggcatagctcgttgattaagtcaacgccttgagtcgcatcccatacaccgtccgtgcaatttatcattacactaatataggacaataagaaaaattgtagtttttccacaaaatttgagctcgatgatgacaaggacgctgcacttaaactgtgaaggaaacgactcacggaagaagggatatcttggttataatagcccaagcaaagaatttgaagtacaatgccaaggttatacttatcttttgcattaccttgcaaatcgaggaggatgactaggttcttgtccgtggtatctctaataaaaagtctgtccaagagggacagaatatcgtcttggttgaagatatgcaatatgtcgaacagcggtccagcaaaaaaagatttaatgcagctttccatttgaggaaaactaggcaaatctgctacaacatcattttcatttaattgcgatttagtgcattcaggaagtggtttcaagactttccataaattttgaaactcagtttgaaacttattttgttcaaacaaagataaagttttccaggaggtggggccaaacacatacctcgagccattatcacctaaaaccgaagttctcagtgaccgtaatggattttctgaactcctgcaatacaccggtttcgcattattgttatcgttttccttcagtagagtctgcaaattctcaatcttctgaaccaacgctacattgggcacttgctcgaacagttccgtattagacaagggatagttgaactcttctgtgtaaacgcattgcggtagttttctaattacacattgctgacacataggcctggcctgactgcatttcagttttctttttctacaaaatgcacatgacttgatgaccttcctcctcttgcccttcttaccacttaaaacgggctctccggtagtagatgtcataggaaaatgggatccatccatcccaacaaactaagtgccgtttgcctctttcttattcgtcccgtaccaaccacgtgttttccacctgtcatgggcttttcaagagtttgccaacgcggaaaggcgccgcattgcaccttgtcgtgatgtattctaagtacaagtagtaaagaagtaatgaccctgttgttattgccccactgctgaccgctgttaatgcctcttcatgatttctgagtcattgttgtaccctctggcgaataagccactgttggttttgtgtgcatattggaaaggcgttgcaacggactgtaactccacacacgaaagaacccttaattttcagccgctcgttattttattcagttgatcatttcttgtataaatagattcaagcaaatttaaagttgatgattctatcttcacagctagagctctacgtgaaatttgtgcaatatataggctgtgatttcgaaagttatatattctctgggtagaagtgaaaaggatggttgccgctttaacgtatttgcctactgagcttatccaaaggatatttgagttcactgtggtggaaacagactctcaatattggttgtacaatttagtggctctaattgatttttctgtctcttcgagaggtggtggctctataacggaagacttcttgacaaattacgttaggaagaatttgatggttttagatctgacctgtgaggccacgcaagactcgattttacgagcggagtacgggtttctgaagagattgttgccatacattgacatggacgcacaatatatcagagttgttgatttggaaaccaatgttgacaaggcccagaatttaaaagcagaaaaacttattgttatatttgacgaattctcagatttgaaactcatagaaaccttcttccctttggcgaattccaattcaaacataaccgagttcgtattctgtgttcgcaatataaagagttcgttttattcacctttggaaaaattacatattgcgaacatagtcgcagatattgatattaacacattgtacctggacttcgtggattcaaatatctattcggatcaaaatttgtttgggatttttgatcccgatatatttcagctgattaataaaaactatagaaacttcttttctaagactaacgaaaaggggaagaaaagaccccccatttgcaagaaaatctgttttccctttgttgaaacattgaatttggattatatggcccttgattcattctttaattcgatactgcataaactaacaacaaagataaaaacatttgaaaggaacaatgagtttgacgtggataaaaatttaaatttaaactcgacaacgacagtagcagctttaattatcaagtcgatcttgcaacaattcttcaacaattttcatatcagcttccctaatttggttaccttgaattttattaagatgtctacctacccaaacaataatgaaattacccaatgttgtaacttcatagatttatcttcatatgttctaaacaaatgtttaagtgagaatatctcgataaatttcctctttcagttgcattctttgaaaaattggtcaatgcccaagattaaagaattcactgggcacaaattcaagtatgacgaaacaacattttcaggttcaccagaaaggtacatcaaatcattgaggggaaacattaaaattctgcaagaaatggcaattaacgaaaccaacgatggtacttgctatttcagagtcaagttgatacctgagggggtagaaaaaactcaaataatcgactggatcccctttacttcttcatttagcgatgataccttcaaacaaagacaccatttaaagaggccaatgatttgcttgaagaacaactctttaagatcgcttactgtcaaaatcatacgtattgaaaaatgttcatccatccgaatccagggattttacctaccaaatctgcaggaactgttcatcaacaataccctttgcgacaccacccaacaccaaaaacaagcgtcaaatgatatgagttgtatagagttcacttcatggaatgaactaccacaatgcaagaaattgggatttgctcaattagaagacgactctaactacgttcttaatatcagtaacctacaagaccatttaccaaatctggacctgcgggagagtttcccaactttcttcgatataagacagaagtttgtcgtggtttgaggtctaattttcaaccaaacgtgttgtactagcatatataattaaataaatttctctagttatcacttgatttatctaatcagagacgtcataaacgaattttttttttagcaataaatcctcaacgctttttgttttcatttttcggtctttttctaccatagaagataaacaagtagagcccatgtaatataatatatctacaacctattattacccaaaaccaacaaaaaccttgacagtgacaccccgttacacactcacaattaagtagggatgataaagtcaacactaatctacagagaagatgggctgcctctttgtacgtctgtggacaacgaaaatgatccctcattatttgaacaaaagcaaaaggtgaaaatcgtcgtttccagattgacaccacagtctgccacggaggccactttggaaagtggctcttttgagatccattatttgaagaaatccatggtgtactacttcgtcatttgcgaatctggatacccaagaaacttagcattctcataccttaacgatatagcgcaagaatttgaacactcatttgctaatgagtaccccaagcctaccgtaagaccataccagtttgtaaactttgataactttctacagatgacaaaaaagtcatacagtgataagaaagttcaggacaatttggaccaactaaaccaagagcttgtaggtgtcaagcaaatcatgtccaagaacatcgaagacctactttacaggggagattctctcgataaaatgagtgacatgagttcttctttgaaagaaacatccaaaaggtacagaaagtccgcgcaaaagatcaacttcgatctcttgatcagtcaatatgctcctattgtcattgtcgctttctttttcgtctttctcttctggtggatcttcctcaaatagacgtcaccccatcatcccacatcacaaatcccgatcaatttggtccaagtgtataacatagtctagttcagtattagtataatatggcaatttatttgacataattacgtatttttcaggcaagctggcgggtgacccgccgcactgcactttttagggagtcttttcaaggatatcatcactatatatcgaaggaaaagaggctttccaactcttttggatgatcgaattgccatcactactctattaaccgtctgtgtattaactaaataatcacatagtattaagttataattcctggaaaaaaaaaagaaagcgaaacgacaaaattagcatataccatgtctcaactgccaacagattttgcttcattgatcaagagattccaatttgttagtgtcctcgattccaaccctcaaaccaaagttatgtccttattgggaaccattgacaacaaggatgctattatcacggctgaaaagacgcactttctatttgacgaaaccgtgagaagaccctctcaagatggccgctccactccagttttatataattgtgaaaacgaatattcttgcatcaacggaattcaggaattaaaggagattacttccaatgatatttactactggggtttgtcagtgataaagcaggatatggagtcgaaccctaccgccaagttgaatttaatttggcctgctactccaattcatatcaagaagtatgaacaacaaaactttcatttagtcagagagactcctgagatgtacaaaagaattgttcagccttacatcgaagaaatgtgtaataacggtagacttaaatgggtaaacaacattctttatgaaggcgctgagtcagaaagggtcgtttataaagatttttctgaggagaataaggacgacggcttcctaattttacctgatatgaaatgggatggcatgaacttagactctttatatctagttgcgatcgtctacaggaccgatatcaagacaataagggatttgagatattctgacagacagtggttaatcaacttgaacaacaagattagatccattgttcctggttgttacaactatgctgtccatccggatgagttgagaattttggttcactaccaaccttcttattatcatttccacattcacatcgttaacataaagcatcccggtttaggtaatagtattgccgcgggcaaggccatcttgttggaagacatcattgaaatgttaaattatctaggaccagaaggctacatgaacaagacaatcacctacgctattggtgaaaatcatgatttgtggaaaaggggtctggaagaagaactcactaaacaattggaaagagatggtatcccaaaaatacccaagattgtgaacggttttaaataaaggttgttacaattctcacatcatccacctttttcctactctcattttctttttttgaaagttgtttgttttatataccttagtttcacaacaacataaggcatgcctatttgagattttgtgattaaaaaataatagaatacgtactatataaccgtcggtttaaagtaaataaattaaagactaagaatgaaacaattaaaaacactgttcaataacgttgctctatcctcctgagtcttccggatcctgtctccatttttttgtgtggtgacgagttgagataaaaagatttccactgctgagaataatatctataatcgataatgaaagttagaacgatcacgttgactctgaaatatagtcaatagaaaaaattaggtatcaattcaattgtaatatttactggattgaatttaatttaagaattacaggaataagaggacggacaataagaggtacgctacacatctaccatcactttcagggagggcataaaatggaggagagtaagacaaaaagaaaagaggatcgcatagatttgaagaatacaccgcctcagaagaagtcaaaaagagattcaacaaatgacaaaactgcaagcacatcactacgttcaatcatgcccaggggttacaaaatgatggaaaacatgggttacaaagaaggagaaacattaggtagtaatgaaagtgccctaaaagagcctattaaggtagaaatcaatacaaaaaggaggggaattcgtgcagaaaagcccgactcatcaacaatgaatgacatgcagatgagtgaacaacgatttataaaaagagaaagtgaaatgaaaaataataagcggttaaaaaaaatttggtataggatccaaaaagttgcttttgaaatgatgggtgattccgatttatacaatccaggcgaagatccgagagactttaacgtactttggagatcttacgttatgcaactaaatgaggaagtagcaaaaaatgacctaaataatcacagtaacaatgataatgaagataagaataatatgataccaatggtaaatgaaagtttggaggcttcgcctgcaataaaaggtgaaaagtttggacgtccttctacattaatagattgcgatacttcaattatcggtagtcgcattacaaaagacacagaacttgccgaattagaagaattgagcattgaaaaaagaataacaaaattgaatatattcctgagatccgagaagtactactgttttttttgcggaatcaagtataaggatgaaggtgatctctacgagcattgcccaggagtgaatgaagacgaccacaaatgaattttatcgagataggtaaagtcatatttcaagaagaaagaaatgaacagcttttatttatataataacatataatataaaacggaagaaacgggtaaacgtcagttcgattattcttttgcggatacaaccttgaaaccttgctccaataatgcagtgacgtcttcatttttgtatggtagattgtttagtacgaatgcaatatcatcccattgcttttgggtctcgcactttcttagtcttccaactaatttctcgtttaattgcttttggtgccgttccttatcgataaaagtcaacagaaatttgatgattttcttgaaactctccttacccaataaatcatctgacgataaattactaaagatatcgatgaatccattataaatggcgttgtccttggatgctaactcggtgaaaaataatctgcacatatcacttattccctggtctggattgtctaggcatttggccatttctcctaattgtcctttaaccttaacctggccagctaaaatcaagaaggtaactgtcattaaacatgttctttgtaccattaagttttcatcatgcaaacggcgatacaaataatctgtgttttcgtccactaagttgttgaagcatactgccatgtcacctagtcctaagacagcatttgagcgaatagtaggatcgggagatttttccattactgtgattaatagcggcaggctcttttcacaatattttgatgataaacacattagtttttctagacataaggttgccgttctttgaagcattggatcgctaaacctgcttgaattagaaacaatctcttctacaattgggcaaaacttccctaatatagatttttctccaaatagtaattcattctcttttacaaattgaatagcatccgtgaaatcgtcctcattagtacctcctatcatttctagctctttatcaccaccgttatcttgtgtggtgttagttacatctgcaccttggttttttactttaccgttccgagtttctgcctcgatctttcttttcttgaattctgcctcacatttctctagatagacaagtgttttaatcgccacttgacccacaatgaataataattgactgagagaaacaactctagatgattgttctaacgacaaaatagagtcttcctcttcaggtttaccaaatgtcatcattgtcttttctctaatcagatctgtagctagtatatcaggcttagaagagattgtaaacagtgcactaagcgcttgttcgcacataggataatattcattatccttggtatagttgataattatggcatacaactttttcactgcaacatcttcaagctcttgatttattgccttggtaataatagtgcttctcttgggaaccattctctctaacgctaaacaagaataccgacaaagggtcagatcttttaaaccaacggcaccaagtccaatgtttaaaagtgactccagtccttttaatgctatttcgttatcggctaacgataacattcctaaaataataatagaaccatgaatttgttccttagaaaaccctttttcggagtcacggttgttcacattttgttctttctgcatactggccttcgatgcagaattgtaaatagcccaaaggatattaatgacatgttgatcaatcattttttgttcatacatcattcctaatagctgttccaaagaggccaagtctgcaatagatgcgccgatgcttagattaattaaatttttggcaatatgtgccgccttctcctgcatattgcaactatctggcgcggttaaaaatagctgcttataacattctatcaaatgtactgatatactcgttccttcatcgtttgtgcccttcatccaaaccaaatgcagcattttttttataccaaattcgcttaactcaatgtcaaaagcgtctgctaaaactaggaagtccattgattctaaaacttcgtttctgttcttagaaaacagcaaattagatatcaattcaatactcttgtgtatctctttaatgaaactaatggcatctttatagtaaacaatcattaactttagcttcatgagaacactggtatttgttgccgtatttatattctctacctcattttctattctagaaagttctgcgctcttattgaaagatccttctaactcggtcctacattgaccttcatcttgttctacctcttcttcaatcaaagacctttcaatcgtgtcattcagagtttcttgtgactctactttctttaaagtggaatttagctgtgattcagaccctttgagatattcttcccattcactcagcctcaattggctaccatgtatggccttaaaaggatgttttagcaataattttgaaagtaactttactgagttcctacgaactaaagaggagcggtcctgcaatgatcgtactgccaatgaagtaaatttagctttgcttttgttaaatttcgaactcaaatcgcagatctttgaacacccttgtatcgccttcgttctaacgtagggatttgaatcctggaatctttcttctagtaactcaataagtacggctatttgttgtttataatgttccatagtttgtgggtcttgagccaattcagccacaatatttccacatgcttctacaacagaacatctcaatgttatagaactattgttgagtaaggtgatgacaagattcatctgtcgaagcattattcctggtgatagctctgataatttaatcaaaaaatttgatattgcctttgggcctgtggtatcctttgcgttaaataccctggtgctgatttctttcaagatatcttctgttagttgtggatagttatattcatcattcaatagttttagtaattctgcattaaaaaccgacaaatgaagaaaataagttaaatttgtcatcaatgaactttgtatacttgaactttgaccgtgatttttaacacacatagccaaaatcctttgaataaacatctttagtgatgataccttcgtcacaggttcaatctctaataacacaaataatggtcttgtgaacaaaccaataaacaaatctttttcaggagttgtctgaaatatcttagataagttaatctccagtagctttgttatagattcaagcaagttttccatttgattacagtctcttttaaacagctcgacgtttgcactatcattcttactgtttttggcagaacggtttaaattagtagactgcgaggagaccttatgtaactcatcttgtaaaaacgtcaaaagtacctgaataaggtagccatactcttctaaatgccttttccactgcggtatcaggccaccaatttcagtaaagttaacatttgatgagagattagccttaatatcttttgacagattcgacagagatgaacttatcaaatagcttagttgagtttgtaatttcggtgttaagtgcgggaagtcatggcaaagatctattaatgcttctagtgaatctggactagcatctatttgttcgggtgaaacggccaattggtctatgataacattcagttctctggatgggtcctgcaagcgaggatatgattctcgatctgttgtttggaacttggtcagatactcggaaaggctaaagccggacatctcataaagtaacgaagtcagttaccacctatcaaaggataaagatattgttactgctgcttcctttacctttcttttttttggtcagtgacaggttattttctttgtttactaaatggtcgcaagattttcgcgatgcgtttaattttcatattattgctttccaatttacccaaagtgcaattgacaaaggccattagtccttcttttacaacagtaagaatataaatatacaagtgcagtatttaagatacttaattcgaaaagtgaaaaaaaaaaaaaaagaatctggaattggttattttaatttctcatatgaattgctttccaaattcttgcaatcaataacatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacgatcaagccagaaactccatagatatcctgacccttactcgttgtaaataaaaggctcgcgacaagaaaacaacgcgttacatgataataattttaaaatcaaacaaaagaggtgtgggaaagaagcccttactattgaatagcagacatttttttcatctcacaatactactacatttctatgaaatataacaggtataaaaatgatttcgcccaggatcgaactggggacgttctgcgtgttaagcagatgccataaccgactagaccacgaaacctattatttatgtttannnnnnnnnnnacaacatttaatccacgtttcaccaacaattataccaaaataaaaaagaatgacggcaaaaaagcaaaaagtgacattaatcatatttgtttatgtcttattctactggtagtattcatccattagtatattactctctatataaggttataatgttgaaatgataatcaactattgtgtatgatcaattggtgaataatttgataatcgttgggattccattttgcttaaggcaatataatattatgtatacacaatatactagaagtttctcctcaaggatataagaatcaataacagggaaacaaaatttctccacaaaattatataattatctttcttccattttatatgtttcacatcctattaatcctcaattctcgcatgtccggtttcatattaaatttgattactgtttcacatagtatatttgttgaaatgaaactctaaaatatcatttattagtagtattcatgttattagaatgtattatcatatgcggtgtaagaagatggcataaagattgagaaacagtcatcaaatataatggaagctgaaatgcaaggactgataatgtaataggataatgaaacatataaaacgaaaggtgtaataattataagattttgtggagaaatattgtttctcttttattgattcgtatatccacgaggagaacttctagtatatttcacatactcaataatataacgtttactaaagatggtgttaacatgttaaaaaaacttcgattgttaagagtcctttttgttatacaactctttaaacgactgttcaaacctatcatttcatcacaaactgtaaaggtaagagtcaaagcagatatatcacttatcaactgcagctaaatatcgtgaaatgaaaaactaatcgttatttgcaccaataaagaacgaaaatcccccactgaatttaaaatatttctaaagaactaaagtcatttcaactaatgagaaactaaagtcagaaacaaaaatgcaaaagcaatattaacttatgtgagtaaaatatttcatatctaatctatgaaggcaaaagaatatgattaactattttattaattttaattaaaattttattctcttcattccaaggattttgttattattgtaatatgggcgatggttagggtgacggcgacttataaaaataatcacgaaaaatgtgaattttattagggctaagagagattctctccttatattctcctgagctgtcactcatattatcacctggaaaaaatggtaatgaggttgtgttattcaagggagaaatttccggagatgagctttccctcccgctgttgatataatcttggtatagtaaatcttcttccgcctttatggttgcaatggataactgagagcaagaggctgattctactggtcgctcctcttgttttttcatcaatgtatcggtagaattattccaagtggtgtaggtgaaggaagttctatgctcatcatcgtgtaatggcgtctcgtttaacgtggtccttgtcttagcgcttttccactctttggccaaattatcttcaagcttttctgtttttaaacctaaggtcctatcgtcggtatttaatgtgaatgtgtcatctattatgggaggcctgctaaaaggctctggtttcggataatttttaaattgtaagatatctgagtcagccagcgctttccctagtccgtggttactaaattcccaatagttaaaatcttgtagcgataagtcatatgagctatcggacatgtcctcattagtttgagaatcaggcggttcaaagaaataattaaatggttcaatttcacaatcaattgtttcagctttgaaagtttggggtacaggttcggttttacaagccgcttttgtttcaaacgattgataaaatttgtgctttaacggggagtcgttgtagtaatctgtatctttaatgaattttctgagaggctttttagaatttttattatttttcgacatagtaacctccgcattgctagccctcattttggaaggcccaagattggaattaaatatcgatgaattcgaaaccgcacgatttagatttattgctgacaaagagatcgttatttcatagtttttatagtcattattatcgtaaaatgatctataatcgaaaccatttacatcataacgacaacagaactgcaaattcaggagacaagtagttttcctttcaaaaaagttagcgtaaatcaagttttttgatattagatttaacttcaacgcagatatatcaataataaatttgaattcgtcaacatgaggggtgacagacttgttgtagtgtgcattaatatagtgaatgtctgcccagttatttaaagtaaattttatctctatttttttctcgaagttcaaattattgacaaatataaggccccagatttgacagttaccaaaattattgctacaaatatcctcgtagcttacaggatcagatagttctaatgaatgaacctttatattttgtccatttaagtatttgaaaatcttgtcttctaactcagtaacgtccactttacagtcacttttgaatggattcaaattattactgaccagtttccaatctgccatatcgaatgtctcctcttcaccaaagcagagaatctccttttcaatgaacatgctacgatcatgcataagcattgcattatcctctacgtcactctcgttgtcatactcaacatccttattgtcatattctaaatcactgtaatctaaaatgtctaaactataacgatgatcttcacctccaatgaaggggaacgttagtggaatggcattgttatgtaaatttcttgtaagatttgaagcggctttttctgatatcgagataggcgccaattttgtgttgaactttttgactgtgtataaatgtgcagcaaaccttaccgatttccctgatgatgaagatgatgtcgacaaagatgcagatgtagagtcttctagtggtgaaaatgaattagaggttgttgaggaaacaaaagaagaagtggagattgtttttgcgagtttcaaagacggtttaagcttcttaccatggctgtaaggcatttgtaaaaacaaagagtaaaattattgaccttataacaagcgtcaaagaaacgagcatagaagtattatacggcctttatttgtcagattatactccagacttagtaaaaaattcaattaaattccaaactgcttaccccagatttagtgaataagagccctttattctacccgcttatctctggatgtaaaacaaataaacgcgtaatagagcagtcaaactaacagcagtaaactgtcaatatcaaaaacgtaacaattgattcaaatcagtttattctaagccgcctatgccagccttttattttcttctcctcctcttcactcccaggttaagccatttagtttgttgctatgcggtgtgtggcgtgtttcccttttaggaaaagtgattacttgcagtttcgcgaaatctcgaagaattttttcaacttattgaaagaacatgaatatacttgttaacgtgattaaacgttttatcagaacaacctaagagtatctccttggtgaatcagaagccagataatgtcatttgatagaccggaaatatacagtgctcctgttttacaaggagagtctcctaacgacgatgataatactgaaatcataaagtccttcaagaatttcattttggagttcagacttgactcgcaatttatttacagagatcagttaaggaacaacattcttgtgaagaattattctttaacggttaacatggagcatttgatcggatataacgaagacatatataagaaactatcagacgaaccttcagatatcattccattattcgaaaccgcgatcacacaggtggctaaaaggataagtattctgagcagagctcaatctgctaataacaatgacaaagatccagaaaatactagtatggatactgattctctcttattgaactctttaccaacatttcaattaattttaaactccaatgcaaatcagattccattgagagatttggattctgaacacgtctccaagattgtccgtttatcaggtattataatatccacgtcagttttatcttcccgtgccacgtacctttctataatgtgcagaaattgcagacacacaacatcaataacaatcaacaatttcaattctatcacaggtaataccgtcagtttaccacgctcttgcttatctacgattgagagtgaatcttctatggcaaacgagtcgaatattggtgatgaatcgaccaagaaaaattgtggacctgatccatatattattatccatgagtcttcaaagtttattgatcaacagtttttaaaattacaggaaatcccagaactggttccagtaggtgagatgcctagaaacttaacaatgacttgtgaccgatacctaacaaacaaagttattcctggtacgagagtcactatagtaggtatttattccatctataattctaaaaatggtgccggatccggaaggagcgggggtggaaatggaggaagtggtgttgctattagaacaccttatatcaaaatattaggtattcagtccgatgtagaaacctcctctatttggaattcagtaactatgtttactgaggaggaagaagaggaatttctacagctaagtagaaacccgaagctttatgaaattttgaccaactctattgccccctctatttttggtaatgaagatataaaaaaagccattgtatgtttattgatgggtggttccaagaagatattacccgatggtatgaggttaagaggtgatatcaatgtactattattaggtgatccaggtaccgccaaatctcaactattgaaatttgtggagaaagtgtcacctattgcggtatatacatctggtaagggatcttctgcagctgggttaactgccagtgtacaaagagatccgatgacaagagaattttatttggaaggtggtgctatggtgcttgctgatggtggtgttgtatgcatcgatgaattcgataagatgagagatgaagatagagtggccattcatgaagctatggagcagcaaacaatctccatcgcaaaagctggtatcactacagtgctaaattctagaactagtgttttagcggctgctaatccgatatacggccggtatgatgatttgaagtctcctggtgacaacattgatttccaaactactattttatcccgttttgatatgatttttattgttaaggatgaccataatgaagaacgtgatatttcaatagctaaccacgttattaatattcatacaggaaatgctaatgctatgcaaaaccaacaagaggaaaatggcagtgaaattagtattgaaaagatgaaacgttacattacgtattgtagattgaaatgtgcaccaagactttcaccgcaggccgctgaaaaactgtcatcgaacttcgtcaccattaggaagcaattattaatcaacgaattagagtcaacggaaaggtcgtctattccaattaccattcgtcaattagaagctattattagaataacagaatcattagccaagttagaattaagtcctattgcacaggagaggcatgttgacgaagctattagattgtttcaagcttccacaatggacgcagcgtctcaggatccaattggcggcttaaatcaagcaagcggaacatctttgtcagaaatccgtcgttttgaacaagaactaaaaagaagattacctataggctggtctacttcttatcaaactttgagaagagaatttgtagatacacatagattttctcaattagcactggataaggccttatatgccctagagaagcatgaaacaattcaattgagacaccagggacagaatatttacagaagtggtgtatgacaacaataaagtcttagcttgacgccttttctacttgtttgcatgtaatgaatctaaaaaattcgctacaaatacttcattattatatttctatataaattctgtaaacgaaattatactttttgagatttcatctgcgtctcatattctttttgtaaaataaacgcacagacttgatatgaccgtcaatcaaaataattcaaagcttcttaaaaaagaaaatgaaatcaaagacatacgaaagaaattagaaaatagaggtcgatttaccactgaacaatcctacagtacatgagctcttgaagtgacttcatggggaccaatttgttctatcgtgatattactacgggtaatactaccaaatgaaaattatcttactcaaaaggtatgacaagaacatcatcactagaacatcatcattcttaatagcaagggtcatcacgtttgccccgcctttgacagttgattagaggagtattataaaaccgttttattatgtcgtatgtttgatcttaaccatttttacatcctataatttggagtgaatttttatatactaacttaaaagtaattgatttgtatctttccagttcacaaataattgatcgtccaaaacatgaactctctagagcagaattagaggaactagaagaatttgaattcaaacatggtccaatgtccctgataaatgatgctatggtgacaagaacacctgtgataatctcattaagaaacaatcataaaataatagcgagagtgaaagctttcgacaggcattgtaatatggttttagaaaatgtgaaggagctttggacagagaagaagggcaaaaatgtaattaatcgggaaagatttataagtaaactattcttaagaggtgattcagttatcgttgtgttaaaaacccctgttgagtaaaaagtaagacaagcagccctcaatctacaaggaaagcaaaccatcgtaagaaactttacagccagcggaaagcctttttttattttggaagtaagaccaattattattggctgattttctagctcttgcgaaagtattgtattcaagaaagcgaataaagcatctatattatcacatttaattaaagagcatttgtaataagtagatttttacataaaatatagaataaatatcaatattattaatcatttgaagttcttcaacgggtctactttaccattctttggcttactgactcttccctttttatgtgaatggcgcttcttagcattgtggaaaggaacaaacttgactttggttccgtttcctctggctgattcaggaagcaagtaatctggaacacgctttaaatgctgttgcactcttgctggatgtaattctttatcgtgtcttaaactttgtagctcttttggattctcctcaaaatgtcttttcaacttctcacttgccaatagttcttgtttcaactctttgaccctagcttctctaatggcaacttgagtaacagcacggaaaccgtcttccattctgtaacggaacgcctcgacctgcttttgatcgaatttgtaaggctgtaattctaatccaagtttgctctgttgtttgatgattcgtgaaagaatcctttcatccttctttgctgtctgtagcattgatggcttatgcttaccaaattctttcagtgggactacgaatgaaattgcagtaccggtctttccgccacgagcagttctacctactctatgcacgtaggacttagccgtcgtaggtaaatcgaaattgaggacacatgcaacatttttgaaatcaacaccacgagaaacaccatattccttatctttcttcacttggaccttctttttcttgcttggtttcttatcgttctcaggctcgccttccaagcttttttcttcttgattttctgtattgtgcccttcttctatttcgtcatcttcctcttttatgtactcggtgtcatctgtggcaatcaatagttggtaaacgtttttattgaattggtcaacaatatgttgcctcgaattaacgggtagctcgctgtttaaaatacaggacttgataccaaattgttccataactagcttgagcctatatcctctgtcaatattatttacaaaaattaatgttttacccttgattaagttaagtttaaaaatgacatagcatagtaagaatttgtcaaattcactgactttaacgtaatattgaagtaatttgttttggttcttatttatttcctcgtcattgaatttaagaatagctggagaacgacaaaatttttgtttcaaagcctgtatatcgtcatttagggttgcactcatcaaaaatgtttgtaaattttttttcaatggtaagtactctccaattttgtttaaatcatcttgataaccaaatgttaacactaaatccacctcatcaactactaaaaattttagttcgttcaatgagatagaattaatctttgtttgcagcaaatccaataatttaccaggtgtaccaactatgatttctggttgatccataagtagagtgctcaaaactgagtcagacatatcggatgatatgttcaaagttcttatatcttttgaacaatataagactagtttttctaaaacattatatacttgttgagccagttctcttgttggaacaagtataatacctagtgtaccattttcctctccgttatcaattgtttttttatattctaggatagtttcaattacaggaatgaggtatgccaaagtttttccggaacctgtagcggcctttgctataatatctctcttctgttgtaaagccaaaggaatagcatgtgattgaattaatgttgggtactgaaatcctatattcttaatagcttgtaataaacgagagtcgagatgaaatgcttcgaacgttgtagaatcgtcaatgtaagcgccttccacagactttttctcatagctcatttttttgatcttttgttgcagttttggcttagtctatttcttttgtgagataaattgtagattgactataactatcagccaaaacaaaaggctcttactcaatgaaagaaattagaagaatcgaaatgaaatgagatgagatgagatgagatgagatggcctagaagagttattctttatgttcgtgaaaaaaaatttttaaaatttcatctctaggtttcattacgtaaagagtgattaaggtaaacaataaaaagcagttctaaccagattttggtttggtattacttctataaagtagtctacttagtatgcgtaactgtttttaacatagcggtgtgaccaaattaccaccaatatttaagaggctttccaccctacctttcaaaggatttgaattacattctaaaattttcatattgttgaagtcaatcttagcagtgcttttacctatggtaaccactccagttatagtttcctctttattacttgcatattcatctttattgagaaataaagtaaaacagtcaccaaactgttctttaaacaaccttgagatttgcttcaccctctcaacttcatcaatcttaccttgtgcattagactgcacattgttatgatcatgatcatcacaagaatgactcgaaagcttgacactggcgggagctgaatccacattcataagtatagcaataatggagtctgctacagtgtcattcattaaatcttgagtccattccacaacggctagagtattaacaatagttaacttaatatcacccattatctgtagaatcaatttacctgtattggtcagattgtcttttgactcttctttaacctttggttcttgatttgttactctatcatcatcttgaagaacttcagcctctccaaacatttgtaaaatgtgccagtaaattagctcctttttacaatttacacgaactgactggcgctctcttaatatcgttgtagaaagatcgggatggtgctctcttaaatcagacaaagaaaggaagtctaattcgaaatttttgtcatctgaaactagaatcccagaaacgactatgtctttgtgttcctcttcatcaaccaaacctttttctgcttgagaatccaagttgtcttcgttttcttcctttataggttcaattttagccgcaatttcttcctttatctctacgttttcttctttatatatttcgttcacaatatttcccacagcttttgcaaccttgacaccttgaaattcaagatctacttcaacacagtttctaggattaaaaacatggacttcattatctgtaccctttaaagacgcgaaattggataacaatgcagatttcaaacggcccatgggattggcttctccatgaacaaggatgatatttggcgcactaatcttttcaataaattctaaattttcctggaagtcaacgtgtgcggcaaaggagatttcttcaacttgacaacgtcttggaatggttatttccggattatttatggaaggtattgtatctggctcaagcataataaatttcgccattgttccttcgatggagtaaccggtgattagtactagatttttatcttcagggcaccacctttcaagtaaatctcttgataacccactttgcagcatacctggtgaggccaacatcacactgggaccaaaatcttggaaatcctccaagtttctaagataagatatatttttgaatatgaagggattagtctgagagtctctaaatttttttctaatgtcatcattcatcatatttacataggtttgaaaaacgctcatacatttttttgccaaatttgatgcataaaatattgggacttgtccaccaccgagttcatcagcatgtcgagaccagtactcatccagtataagcatgatttcttgagctctccctaaagcaaaaacaggcagtagaacacggcctcctctcatcactgtggaatggattagttgggttagcttcctttctctatttaaacggggctcgtgagtagcggtaccaaaggtagattccacaattaatacgttggatgaaagtggaggcacctcagcagaatttaagtgacgatctacttctctcgaataatcacctgtgaataacaccctaaggccagcaatctctatttgaaacatcgctgcacccaatacatggcctgcatggaatgccgtaaatttgataccattgacgtcaacagtagaatgatagtctaccgtttcaattttatcgaaagaatcaactaaatcctcatctgagaatagacctnnnnnnnnnnnnnnnnnnnnnnnnnnnnntacaaaatctcgcagtagccatctgtaaatggctttggttggatgtgtcatgaaaactctgccttgaaagttagtccgttgcatcacatacggaagtgaagcggcatggtctaaatggaaatgtgatatcagtaagatatcgactttggaaagatcaaattcatcgtaaaaaggtaatgaagctaatccttgatatgccggatgaattcctgcgtcgagcatcactgttttacctttatattgcaatatatgacatgatcgtccaacttcgttacttcctcccaatgaaaaaaatttgaatgttgttgtatttgttcgctccatatatgcgtatacttattaatgttaacttattatgttactttttatttcctcaatggacaaaattcaattgataatacaatgtttcttttgtgctgtaacttttgaagtactgaaaacaagggtaaaagaaataaacgcttatacccgtgaacattttgaacctattagatgtgatctcaatatgtattgcgctgaagcagtagaagttgctaaagatccgctagtttttcataattttcggccagaataactgcttacccgtatttatttgcaaacacgctacttagtcttttggagaggactttatacaggaaagaaagacttttattgattttaaaaacaatataaatgaaagaaaaaaatgtgttttagattaggcttataagatatgacccatattataattaaaaaagcaatttagttgttcttttaaaaaaaaagagaaaaaaaaaaaaaaaggaaaatgagtttgtacatactattatattaatgtagtatcacgttaaaaagccgtagtcatcattaatcgtccaaaagtcttctaccggaccagatgtcatcatgttatcccagttagaacgctttttcctgatgtctgcgttagttactgtaggaataacattgtcgaaatgcagatttgcgctagtgtttgcttccacctgtgttttaggtccattcttctctgtttcgtcaagattatattgtacaccttcctgattggacatcatgaacaaatttctgttatacgaagggtcattctgcgtctgttgaaaattattagcggttacattgttttcagaacacatattttgttgttgatgttgttgctgctgtttgtccatggacagagatgaaggctcttgactctggggaaatattgtttgtagtatggacttgctattcaaagcatctagaacggagttattggtccaggtggaaatattgttgatcatgtcatgagcaccgttgctgaaaagtatatcgcccgaagaagagccatttcgagcttgtttgacactgaccggaattgaattgctagtaaatgacgctggtatcgaggagataatattattgccataatctgctcttaggggtgatgtactgaaatttgattcttcgacatctcttaattgcttattttcacttgtatggttagagaatattgcagattgtagaggattactgttgatcataccattgtttaattgattcgtaaaattgctttctgagaatctttgtggagaagtaatatgttgttgtggttgctcccgctgttgttgcggcagtggtcgtgatacatgctgttgcggtagcatattggaagtttgaggatatggagttgggctttgcgtcatcgctattggaatcggatccgaatgcgaagaggctgtagatatgctagaagattttgaaggacttctattggtcatagtatcggtgttcagggacgatagatacgcttgtaaattgtgctgagctagttgctgttgtagaaaggcctgctgttgaaatacttgccaatcaaactctgtttggttggttggtttcttgacgatatattggtcttgaataggcctttctacatcattttccatagttacgttgttgttacgaacatactggctgttgttgccattattgcagctgttgttggtagtgcttctgctattactttcattatcattattattaacattattattattattactattactattattattgttattattattattattgtcattattattgttgtggttattgttgtgttctctgttgacgctgctgatggtcataccattgttatcattgcttacattgattttcaggtttttttcttgggaagaaggaaacgataatgtcgacgatgatgacgaagaagaagatgatgacgaagaagatgttgtataagacattgaagaatttgaaatacgtgacctgtcatccattttggttaataggtgagctaaacttttgggtacagaggtcttttctaaaacaccttgcttcttcttgaatttctcttgttcagccaaatccacttgtgaattttccacaaaaccggcgtgctcttcagcttgtcctttaccaaatattctagccacagcaggcggcataccgccattatgagatatatttttatcgtttgaattggatagattagctgcatttgcggagttagaatcatgaagagtacccccagatgaaattgccttattggcctcatcattgatgttcttgggttcagtacgcttggcgacactactagccatgaaaattaactctgaagagtctggaccacatctttcaatcaaattacctaccgtggcattcattaactgatcgaaagtatctctaaaggttcttgcaaaattagacctttctgtcataacatataaacaaacggagcaagctctcaaatcatccatcgtcgaaaagagacttgcactgattaaaggtctagtatgcttcgaagcatcgcctaatttcttcctcctttgatcgtcaaaattcctggctaaccacatacagtagattaaagttacgccagctacaaaaaccgtatgcactgctggtgtagaatgaccattaagcgttttttgatggaatatcttgtataactgacaaatttgacccgcagcagcttgacattctctaaatagtctatcctccggggcgaaaaattccaaatatggttgtataagcaatcgcactgatctatagtaataaagttttagtgtctcgttttcgaaatttttcacgtcaagagtggaataactttttctccaaacttccaaatcttcaaaaaattttcgtactaggggcaattgatcaatggattgcttcactgacctagaatcgtttttcaatagctgcaaagtctctacaaattgagattcaattcttcgcagctttagagactgattgatgaattgcacaccatggtcattggttgatggagccgccgcatgcacaccttttgtataaaaagagtcgttattgaaaagaggtaaatttatttccgactccttgattgtataaggtttccccacagcaacacaaatcattctttccaagaggtaaacacaccaaaatagtcgcagtttcttatttgcaaatggatcattaggataccattgatttagatgaagtttcttcttggatatgcccatgacatccttgattatgtcatatagtatcagagaatctctatcagtcctaataatgtaaaggacaagcaatgtcaacagttctatttgctgaacataattcaaatgcaaaccacacttagtgatgtgacggatagcggtggagaaatatcggtgaggtggaaaccccttgtacttacctgtggtcatcagtaagtaggcgctgatgctgaagacaagccacattctgccggatagaaaatgaaattctatttcagaatacgaatgtgaattcgacggtggtgctgcggaagacgtggcgggagaagatggcgggataagaatcttgttgtggaggtagtggtcataaaaagtatagatttcttgttcgtctaagatagggtacttgaattgtaatcttgtgaaaaaagtgtccaagaaggaacgtgacagcttctcattcagttcaaaaatagggtcatacatcaaaaactcttttttcaaattgtatttggcaaaaatacacttagtgaagtccagcgtctctaaagggtcattcaaaaggctcgcggattggcagatagcattattgttgtttatgttgttcgtactggccgaggtatcgttagtggccgcattaacgttgctgccgttattgtttgtgttctccagcggtttgttggaaggagatggcagcggcagtatgaccatattgctgctgttcggtctagagtaatcagaagtgttgttactgaacaaatgagaaaccttcttgtactgggataattcgtagttgtactggttgcatcccggcgataaatcgagcaaagtctccaaactttttagttttttctccaagaaaatcgtatattgatctttgtcatgcctcatcaggtttggattggaatttgtcgtaacggactttatcgttttcctgaattcattcgcgtcgccagcatcaacattactattgctagtggaaatgggttttattatcgtcatatcattcagagaagtggcagcgccagcgccagcgccaatactgctatcttgcagctcacgttttattacaggatgaggtgtaggaggtacagtgccagctgtaggggtgttgttgttggtgttactgttcgaagtggaagaagagtacttggagggctgcacgcactttattcctgctttcaaacaggcggtacaactgggtaatttatggtcgcatcgttgctttcttcttctacaaagaagacaagacctggaacggccctttttgtcttgcaacaagacgtctgtcctgttaccggccagctccagttctctcttcaactgttgtattttctcctggctaacattcttccttggacggcccattattatttacgtgtattgttggtagttagcccgaagattatgagtacgtgaaatacacttgtctttatgaaagagtggaaaaatggtggggagtaagttatactattgacgtgtaaaaaaaaaaaaaatgttaatggaacgaccgatctaaagaaccatatataatgaatgactaaaaaaagcaaaatagttaagaatccaagaaagatactaagaaaaggcgaaaagaaaaagaaaaagtatgtccgctaacaaagattagcgtataagcaccacacgatgcgattcaggtctcaacgtgcagtgtgcaggagcaggaactattcaatgtattgttgttccagggtttttgttcgcaacccacgtcttgaccgacggtacccgcaggtgaaaattttagcaaagttacactttttttttcattttttttttcttttctcctccatctaatttcacctgcggttaccggcggaataactcgcgcaccatttctctgtctcgggcctcgcgttcctctttttcgactcgagcggcctcttcacgctgctcgtacttcgcgacgctgcgccggcgctgcgagcgtttctgttgacggtgccactgtagaagcgcctcctctctggacagcatcgtgtcgtacgacgccgcaagttcgcgcgcgagcttaagccgggcaagctttcgattttgctcacgtgaccgcgtttcttggcactcgacaacgatcccagtgggttcatgccgtagttgtaccttagaattgcacttattaatcttttggccaccgggccctctgccgccatgaaggaatttctcagtgcattgtgcttccatctctggcgtgaactttggtcgcggtggtagcttgttctttttaatcagcagcactgcggcactgttgattgacctcttactcgctcccctcatcatagtttactagtctcggattcttctgcgctttttccagggtcgcatagcttgtaggttggtagcatagacttatatataaactcatatccgttctaggaacgtatagcgcgctatggtagtccggggaaaatgcacagtttagttaagtgtatagtaattttatcgataaaggaagaatggaagaggtttatgtatacatgtaaactctgaacatctaatagactaatgatgcggttaatacgtacattgccgcttcgatgcttcaaaactagaatacggcggcaaggctcgttgttgtgtttgcggtgctttagttcgtattcaaaaccacttttgcagaaatcaatgtcattgaaaaatatccagttatcagacctatcctcatcgccattatccaagaacaaggagaagcaggagaagccagagaaggaaaacgaaggaaagcactccattggcctgttagacagattttcagaggactttattactcagggcaatggattgaaacctactacttcacaaaatcaattggatactataaagttttatcaaatgcttcgtgaaagaggcaatttttccgatgaacaatgtaaaattatcatagctctattgttgcaactactaaatgatcagttttattcctgttacaatgatttgttcttaagggatatggagctgaataaacaatcacatttgttcagctcgctagaaacagaattgaaattcgcaattcaaaactctagagacacgcaactaaatgagcaccacttgcaattattaaaactcaagagagaacttaactcaatccatgatgaactgaatgaaatcataatagatcttttgcaaaaggacgctaaattagaatttaacaatcaaaaattagaaaacacccttttgtatcgacaattaaacctgaaattgaacgactgttctaacaagattcaaaccaagatactgggggatatcaggtcacatatcgaaaatttaagatggcagacaaccagaagcggtcttttggtaatattagtccttgtttgttcgattatgatcggtgtaagcgcatctaagaaggaacgcccaggtttacaggaacctgaggaacctgaaattttagcaccaaaggaagacattgatactaccttccctcaagatcaacatgatatagattaattagcatacatattgtctgtacataagtatattgtgtgtgcgttttgtttcactgagaaagcggacgtcataaacgatgcttcctttgtttcgagcccagctgcctaaatctttttaagggctctccatctacccaatacttgagagattcatttacttccactgagttagccttattgaatgcatcgatgtggttcgatttcagcaattttttcatccctaagcaactgggcaggtatagccctttcactttctccctcaattcttctaagacctttgcattgaacgcttcagcgtttgaagatggcatgttaaaattcttgcttataaatccgttctcgcacattatatcgtacttgaatggtttgttgaacatgaggcattcatacgtcgtatttgtgccaaacttcaatggcaaagagaccgttgtaccaccttcggtaattagtcctaagttagcaaaggggtatagcaaataaaccttgtcatttatactgtacacaatgtcacataacgctaccagtgccgcgctcaaccctattgctggtccattcaaacagcaaattaaaactttggaatgcttgatgaaggcatcagtgacataaacatttctagcgacaaaatttgacacccacttgcttgtttccgaaggatatttattggtatcatccccttgggcttttgcaatacccttgaaatcagcaccactggaaaaaaatctaccactgctttgtataattgtaaaatatacatcacgatttctgtccgctagttctagtaactctcctaaataaatatagtcttcaccttctagtgcattcaaattgtcagggttcattaagtgaataatgaagaatggtccttcaatacgataactgattttctcattttgcctaatttcttgcgacatattgttcttccttcctttactgtgcgagcaatttgtgccatacactccaattatctatccatatgttcatctttcagttcttatatatagtgcttcacttttattaaccgctcttggggtaaaagagaaacggtcactgctacagcctttcggaataatatttcttatgcccgtcgccaatttcagattctttccttcgtgccgcatttattttatttttcaaaatgacgagaagttaaaatctaaaatcaggaaaaagaacagttgcagatgacgaaatacttcgagcattatcgcaataaataaggcgtgtaaacgtatgtcagatatagaatcattgggagaggcagcaggtttatttgaggagccagaggattttcttcctcctccaccaaaacctcattttgcagaatatcaaaggtcacacatcacaaaagagtccaaatcagatgttaaagacatcaaactccgtctcgttggaacgtcaccactttggggtcatctcttgtggaatgcaggaatatacaccgcaaatcacttggattctcatccagaattaataaaggggaagactgttttagaattgggtgctgctgctgctttaccttccgttatttgtgctttgaatggggctcaaatggttgtttcaactgattatccagatcctgatttaatgcagaacatcgattataatataaagtctaacgttcctgaagattttaataatgtcagtacggagggttatatttggggaaacgattattctccattgttggcacatatcgaaaaaataggtaacaataatggaaagtttgacttaatcattttaagtgatttagtcttcaatcatacggaacatcacaaattacttcaaacaacaaaggatttattagctgagaaaggtcaggcgttggtagtattttcaccgcatagaccaaaattgttggagaaggatttagaattcttcgaattggctaagaacgagttccatttggttcctcagctaattgaaatggttaattggaaaccgatgtttgacgaagacgaggaaacaatcgaagtcagatctcgtgtttatgcgtactatttaacacatgaaaagtagtaagtgggcggaattggcattctcaacaatcatttttatgtttgtaaaccagtgtcctttgatatgtaacaattaaataaaataagtcatgatggggcacgaattcgcaaaatggtagaaacacagtaaatcgaagaaaattaaataattcgttatagatataaagtagtcgattataaaaacgtaaaaacatgaaggcagggtaccttgacgaaataaaagagaggcggtgagatgaggtgaaaaataaagaatattgcaaaaaaaaatattcggactctatgaatcaatctctaataactttaaaagtaattgctttccaaataagagaaattacattgggtatagactgagtcgccggagtcataagcataacatgtggttccagaagcacattccatgtaaacccaagcgctatgatcacaaacggcgaacttcccatcagcagagcatgcaatttcaccttcagtacaggtagatttaccgttcaatttaccagccgcatattgagcattcaattctttagccaatgtacgagctgtactgtctgagcttgtactacctgagcttgtactacctgagcttgtactggtcgttgttggggaaagcgtactagtagtagctgtctgtagggaaacgacagaagaactcttcgttgctggcgaaagagtactagtgatagctgtttgaattggggccgaagaaactatgctagtagtagttgtttgaggggtcaccaaggcagcactggttatttgggaagatagagtagttttcatacttgtgatagcaactgaatttaaagtgctctctgttgtggtggtacctagactagattttgtcttggtgctactcgtcaatgtttttgtagtttgagtaattgatgttttgatagcgctgcttgcagttggagataaagtaactttgcttttactttgtgtagatgtcgtagattgtgtggtctttttctgagaagttgaagcagatgaagttgaagcagatgaagttgaggctgctgaggtttttgaggtggcaactgtagtagtggcggtctggctagcacttgttagcaaattcttcaaaatctcaacatatggttcaccatttagctcgttggaaaaggcttgagatgcatcccataacgcaataccaccaaaagaacttgaagaggcaatatctgcaatagttgattccaataaagaagtgtcagaaatataaccagagccagcagcagaagcagaaccaggtaaacctaagaacagtttgatatttttatttggggatacagtttgagcataggttaaccaagtatcccaattgaattgaccactcacactgcagtaattattgtaaaattggatgaacgcaaaatcaatgtctgcattttccaacaagtcaccaacagaagcatccgggtatggacattgtggtgcggcagaaaggtaatattgctttgtaccttcggcaaacaaagttcttaacttggtagctaacgcactatagcctacttcgttgttgttttcaatatcaaaatcaaaaccatcaacgactgctgagtcaaatggtctctcactggcacctgtaccttcaccgaaagtatcccataaagtttgtgcaaaagtttccgcttgagaatcatctgaaaagaggtagctaccagatgcaccacctaatgataatagaactttctttcctagggactggcaagtttcaatatcttcagcaatctgggtgcagtgaagtaagccatcagaaaaagtatcagagcatgcgttggcaaagttcaaaccaagggttggaaattggttcaagaaagataataggaaaatatcagcatcagaagattcacagtaagtagctaaggattcttgcgttcctgctgagttttgaccccaataaacagcaatatttgtgttagcagacctatcaaaggcatcggttggcagtagtaagaattgtgtgaatagaagaatgatgtaaaggagtgacattctattattaattattttatatttaaattagaatttcaatgtattggaaaaagagtggttttaaaaaaggtaggttgtgaaacgagcgacagttattatttttggatataaaaaggttcaaaggaatgacaggtttattttttttatgttattgagtcttaaatgagtgaaagatcttcaatgttatgaaaaaacttgactgatataatcttaatgtaatgtattgttgttgtccattctataaattatacaaggaaaggtaagtgagacgtttttcctccatccaaggacctaatacctgcatctttttatatctttgaccaatgcctatgaagccaaatacttccgtccatattagtttttttttgttccttgaatcctgcaccgaaccatcgaggggcttagttcttacaccaatgctaatgtttactcaacatctgaaacacataaacaaataaacaaacaccaaacattgcacgttagaaactcatatttactcgcacatatctgttaaggcgaggctggttattttttcaagggaccagcatttccaatttttcaccagcggcaaagaaaaataccaacaagcaggaatcacacccacgcatctcattttgcgttactatgacaactacaaaatttgaatttgttaacgagaatgacgtatataagttcgattttgttgaggatatcccacatattcccaccaaccaaccactatattaatggacatggtttttgccgtgaccgtggatctcgcagctacacaatgatatctcttgtatccgttttagcatgaatttctaaacaagactgattatataccatgcactgtaacattcagagaaaatatactaaaacaattcattgaattttatctcccatgtgtcaatccatttctttctttttggatcaccttcatatagtttactcatttggataagaacttttttagttactgcaactaatgcagcctgttcttcttttacctcctcattggtaaagttcttcggctcaaattgtacagtggataccacttcatccaaaagtaactgtatttccttcagatatgtatgtatactgtctaaagtttctgcttgattcctcttaggagtaaaatcttttgacaccagagttttcctgaaagttgatacaagtaatttgattagctttatcttcctcgtaaacccatcgaaaaacaactttatattttcatagaccttttcctggtcaaattcctctttctgtgaatcagattcggattctgaatcctcaaaatccaaaaatatatcgtccgagtttgctgaaaaatcgggttcctcaagccactcttttatttcattcattgtatcgtccattatggccacattatcttttaagatgtttgctaggatcccataaggtccagccttggaacaattagagagagaatcgcacgcattgaatattttaccaactgaggttaacctttctttgtctagagatgcattttcgtcatttttcaatctttcttgtaattcggcaatgaaatctctcaagccatcgagcaattgtagcgtactttcatccagttggtctgtaaagtatttggggcaatccttgttattgtaaaacaaagggaataaacttagtaagtagaataatggcctactaaaattttggatttcggtaatcacaactttatgattgttatcaaaagttcctggcttgcaaacaatacctatttttgtgcaatgtgccttcaatacagaggctaatttgtctagttccttagttggggtggaaccttgtagtttggtagtagaggagattttacgcaagtcttccggctttttgtatggcactaaaaactgttcatctatagaattcagcagttccaataatttgacgtcatcctttctatcactgcttccagtagacattattgtataactggtatttctcttataaagtttataataggcgtctctggtgatgcttgttgacctcaatggattttgttaaaaggaggcttcatgtcatcgtcaagatcattgcagtttttttctagtttttttttttcattgccacattatgaagcgcccattcaaaaacaactagaaaaacgtttgccaaccctaggtacggcaagatcctccttattaataaaagcatcacaccaagacagcaaagaagtaaatcgataatatgaatagcataattttgcgaagttaaagtcctaaagaaataatttatagttaacactacttacataatttcaatactgctttatatttaaagtaaaaaacgcataacggaaatacaaatacaagtcaaaaactatcttgaagtaaagatggcatgactgctattttgtttcttgttacttttaagctccttttccacaactgttaattttcttattggacggatggacctgggttcattcttctcttaccgttaaccaaggtaacgttaacgaatcttctggtgtacaataatcttttgtaagcacgacccttaggcttctttggcttttcggttttttcaacctttggtgtttgagacttgactttaccagcacgagctagagaaccatgaactttagcctaaataaataatattaatattaaaaattaatgaccatgttagtatagtgaatttttgaattatttggcgtatcagcaaggatgctaaaaataaacttcactctgctattttctcaaagcctttttaactctccgtcaaaaaatgttgttattaaactcgacattatgttaagtccacgctgttgccctcgaaaaatctgtgtcaagcaattacgtttttgatgtaacagaactcaaatttaaaaagtttcctatcatattctcagggtggagccagtttaaagatatattgcgttttatttctttttctgcggtatatatagatatgaaacaccagtaatatattcaaattagctatttcttgttattcattcctcgctgaaacgtccatttttttcatattttaaaatcctaatgaggcattacgtaccatatttgcgtagtttttgtatggggatatggaagattattacagtggcaaatttaatgtgcagttcatgtagcctttaaaatgcaacataccgttcgtaaggctgttttgttctatctattttttctgaggtttccgacaacctcacgacatttttttttttcgaacggaaaaaagaaaagcagttagtatgtaaagcacggatttttttatacatatgtacggatgtgatagtctgcaactctgcaactctgcagttctcagccatgtcagatttaaagagtttccttagcaacgtagcaaagaaatgtaccgctgtagggtttacaagcccttcgatcttgctatataatatatgatttgtcctctttcccttggtttttccacatcttcgctatcttccaagctaccacgatccaacgaacagtggaatacgcaggattcgtcgtgagaaatcgccaaaacaacttcttcaaatgcagcgtataacttggaacacaccttccaatctttgcaacggatgattacttcatgtgtggacgaactttcctgttcagccttttccaccataacggatatgtcattaaattcagtatcaccgctagtatcagctgtgtaaatgtttccccgcgtatctgcgatcgagctatcctcaattcttaataaatcttcatcgtagcggatattttcttccatctctcgatctctagtattggtatatagtgaagacatcggtttatccgcttcgataatcggaagagatccttcctcctgccggccgtctgtgtcgatgtgctggttttgggaaggattgtcagtgagcccttcttggcgttgtatcacagagtctaagggtccattccagcatatttccaaatgccaatctaattcattcacaattatcttaagttctacatcatcaccttcatttccatgctccttttttttgactcccattaaatgaatgtggttgacattactgtaccgttcaacacgtctaataaacccgtggaaggcggagccaaactcgcccgatattggtggcagcttgtacatcatcagttgaatatagttaatcattggctcttgtattcgcgtatcttgtgctcggaataatagtttgacaggtactttgaacgaatgcatgataaccttattgcttgcgagtagatttcctgtgcctactgtggttggtaaaccattgtgctcatccactcccccattcataactatagcgtcatttgggccgctagtatgtacaatttcttcgaatgttatacctagagcacaaatggggttcggttttgaggttgtatctacgcctcctgctgttcctcctgaaagtgttccgttatttgtattccattctggcattgactgtagttttatagtcatattagaggaagatccttggttcattactcgatcataccttttaaacacactcaataaagaatcacaattacactccattgttattgtattgagctcgcgagctgatataactgtatataatctgaatacatcatgaggaatggtacaccaaagctgaccagtatcccctcgtaatattgtaccgttgttactgctgttgagtgatgattttggagtggatattattgtcaatctttcactattaaatcttaagatagccgtctttcgtagcgaagcaactgtattgatagtagttcttagcaatttataatcatcaggtgcttcacaaccatttactatcaattttaatttcatttaactgaattaagacacaccttttgtcttcttttttctctcatcatctccgtatgtttatgttgctattttgatgtaaataaaaaagttgaataatagacgagggcaagtataactcgcctatatttgtagccgcaaccattgaaaaagagccatgaatatgggaaactagttgcacataaaaatgctgaaatttagaattaggccagtgagacatatacggtgttataaacgacacgcatatttcttacgatataaccatacgactacccctgcacagaagttacaagcacagatcgagcaaatacctctcgaaaattacagaaatttctctatagttgcccatgttgaccatgggaagtcaaccttaagtgacagactgctggaaataacgcatgtcatcgatcccaatgcgagaaataaacaagttttggataaattggaagtcgaaagagaaagaggtattactataaaggcgcaaacatgttcgatgttttataaagataagaggaccggaaaaaactatcttttacatttaattgacacgccaggacatgtggacttcagaggtgaagtttcacggtcatatgcgtcttgtgggggagcaattcttttggttgatgcatcacaaggcatacaagcacagacggttgctaatttttatttagccttcagtttaggattgaaattaattccagtaataaacaaaattgatctaaattttacagatgttaaacaggtaaaggatcagatagtgaataactttgagctccccgaggaagatataatcggagtaagtgctaaaacaggattaaatgtagaggaactgttactaccggctataattgatcgtataccaccaccaacggggaggcctgataaacccttcagagcattattagtggattcttggtacgacgcatacttaggagcggttcttctagtgaatattgttgatggttctgtacgtaaaaatgacaaggttatttgtgctcagacaaaagaaaaatacgaagtcaaagatattggaatcatgtatcctgacagaacctctacaggtacgctaaagacaggacaggttggctatctagtgctgggaatgaaggattctaaagaagcaaaaattggagatactataatgcatttaagtaaagtaaatgaaacggaagtacttcccggatttgaagaacaaaaacccatggtatttgtgggtgctttcccggctgatgggattgaattcaaagccatggatgatgatatgagtagacttgtcctcaacgataggtcagttactttggaacgtgagacctccaatgctttgggtcaaggttggagattgggctttttaggatctttacatgcatctgtttttcgtgaacgactagaaaaagagtatggttcgaaattgatcattactcaacccacagttccttatttggtggagtttaccgatggtaagaaaaagcttataacaaatccggatgagtttccagacggagcaacaaagagggtgaacgttgctgctttccatgaaccgtttatagaggcagttatgacattgccccaggaatatttaggtagtgtcatacgcttatgcgatagtaatagaggagaacaaattgatataacatacctaaacaccaatggacaagtgatgttaaaatattaccttccgctatcgcatctagttgatgacttttttggtaaattaaaatcggtgtccagaggatttgcctctttagattatgaggatgctggctatagaatttctgatgttgtaaaactgcaactcttggttaatggaaatgcgattgatgccttgtcaagagtacttcataaatcggaagtagagagagtgggtagagaatgggtgaagaagtttaaagagtatgttaaatcacaattatatgaggtcgttatacaggcccgagctaataacaagataatagctagagaaacaattaaggcaagaagaaaagatgttctccaaaagctgcatgcttctgatgtctcacgaaggaaaaaacttttggcgaaacagaaagagggtaaaaagcatatgaaaactgtaggtaatattcaaatcaaccaagaggcatatcaggcttttttgcgccgttagcattgcatattattgttattaccattttaaaattataccaagctgtatatagttaagtacttttcatttgtaaataaaagagaaaaatagattaataaatataataatggcataatcattatgctttaagtatttcctcaagtgtaactacccctttaaaatctgggttttcgatatttttcaggacggatttgcttacctgctgagtggatactgttggcctaatcaagtcgttcaaaagctgcagcttatttctcaatagaaatttgttaccgcagtaaagtagttcaagtgcagtatgaataaaagaccgtggtccaattgcatttctgtgctcatcgaacataaaaccgggtctcacaataataggcctgaaatatctctgcattttttctagttcaatctccgcctctcttttcgaattaatatagccactaggaatcaatgggaaacctttatcggcggaaatatacgtaaaagatctttgatttgctttttcttgctcctttttgcttttctttaggattttttgtttaaatgtatctgccaaaataatagcactttgcttattcatcatttcataagtaaaataaggactgcttttttttaaaggatttggacctgcaccaaaagatagaaggcgtgattttgaatcatatgtaggggatttggatagagtttgcttataattttcattttctaggaggattcccaaagaatgaactacgttagtagcattattcaataattcatggtaagaatcaggcttaaaaatgtcagcagcggtccattggacctcctgcatccattgcttatcatttaattcattgctatgaggagctttaccggaccttgacacagaaacgacttggtagcccgaagtcactgcttcttgacaaattcttttacctaaaaatccattgcctccaaaaactataagctttggtatcattttctacttcagttcaagctttagctgtatttttgtatacgatacatatttcccttatttttttattttttcaatgttttcctgtttttctattatgcaaaagcgacaagatggcattacgaggagacactcaactaaaaaaaaaaatgagtcaaattgccagactttgtagagaagtaaaaagttaatgctaagatgctctttatgtattagtcttttaacatattcaaggatacgtaaatattctgattatatactaataattaataataaaaaaattgttttgatctacaagatttttatttattttcatgagtaatgtacaaaagacacatcatcacgccttatttttatccaaatgcacatcaatttgcttgtaattatcccacgcaatacgatatataaaacttggattgaacccaccgacgtttgtaatgtagatatcaatattttcaggcggaacataatcggtaatttgattaactgtatctaatctttttcttggatccattctaggtaatatacgttgggacccaccaaattcgacaaacttctctacgtcgaacggatatagaggagaaagcttatacaaacctgcaacagcaaatacaggggttctaaattctcgggcgcattcacaaacggatgatacacctgaatttgacgagatagtccccccattgacaaaaacggctttagtgccgataataaccttacccacacgggacattaaagcaaaaacagctgagtctgggactactagggtttctatgttgtgctgtgctaattttttggcaaactcatgtgcattcttggtgttattagggaacccctctgtaactaaaaccgtaaatgttctattactacgttcgcgagcagtaatcagaaattttaatacggtttttgaatcaggtgtgggagttaataaaatctcatgatcgtgaatcaaatcaatagcaatttgctgaataccttcatcaatgttttttatctcatctataagatccttgataccctgaatggctacttgacggtaatcagtcttggttttcatactagagctccctgaactattttttctattctgatgaggttgctccggtttctgtaataaattaaacatagaggaaatcaaaggttcagcaacggatgtggatgtgacagttgtgctcatagtgtcttcttctacttcatccctcaaaacagccagtattcttctaattacgttaccgcaactgaaagcagtaggatgagctttttctagactattacctaaatctctgatttgttcaataaggtcattaacatggttccaacgagctgcagagataaatcgcattaacagttgtaaagtttccaaggcgatggcgtatgaaccttgcacttgtcttctttttaacttagcaacgaaagtgtcaatggtaacattcacatcagatgttgccgcattcggatgtactgaagtgaatgcttgagaggacatcttatgttgggcaaaagttcgaaagttggcgtgttgtgtttactggttccgcacgagtaatgaatggtctgtttcatttatgaaggttttttctatgtccatttttttttttcagcatcacgaagaaaaaaagcttgcggttgggaagcagaggtatcatatactcaagctgtatagttcaaagcctttcataaaggctattccttagtatatatgataatgggcttgctatgtgtttttgaatctatctaaaatttcttgctatgtagtcgtgtgtagcatagagacatatcaagaaaaggctaaaatatcttcggttatgcaccttattcaccgttatattcggccagatttcttgcagtttctattaaaagggctctaagtttcatatcctctggggctaaagctaaacctctctcgcatgttgccctagcctcttcccactgtctcaattttagcaaacagtccgccttcctgacaaatacgtctggttggataagtcccgtaccaagtaagaaatccaagtcttgcaacgcctctaaatgctttccgagtattaaacataaatctattttactacgaagcataaagtgtagctctggtagctgaatagcaaaagcttcccaaggcgctctttttctttgtgccatttcgattgctaaagaaacattcttcaatgcctcattcaattttttttgttgtaaattcttcataccactttcaaataaacccttgatcattttgcttagagcttcattcggttgtggtgtaaaatttgggttggtttctccaatcaaagatgtagtgagaacatttatttgatcgatattagtttcggtagatagtgcaacaacagcatcactcgcagtgatcagtttactgtttgcattgtattcaagggtaaccatggttgaataagcttgctttggtatgcctttaacgcaagttgaaggagacgtttctttgattttaaggctattggttttatgttcaaagatataatctaattgttacgtgtgctcctacatccgtttgaaacgatccataaacgatctaaaaaatataatattagacaagccaaatacgtttaaatatacttaaatcacagcatattcacattcaactatttgttatatatttaaatctgttttataaaagacaggagtaccagttagtttgtgttttcttgttgcaattataaaatcttcaaaatcatgtggatttttattgaatttctatatcgagatgaatgtaaatatgtatacagtttagggtagggaaaaaagaaagcttgttctcgtttgtcccttataaatcagcatcatcttcatcaggcaatggcaaagcagtagcttgttccatttcttgttggtattgttgcatcaattgttcatcgacttggacttctggtggggctaaagctggagaagcaacaaattctaattgtgggttaccagccaattttctggccaaccataagaaaggcttttcaaagttgtagttggacttggcagaaatatcgtagtattgcaagtttttctttctgtggaaagtgatagtcttggccttgacctttctttctttgacatcgaccttgttaccacacaagacaattgggatgttttcacaaacacggactaaatccctgtgccagtttggaacgttcttgtaagtaattctggaagtaacatcgaacatgatgatggcacattgggcgttaatgtagtaaccgtctcttaaaccaccgaatttttcttggccggcagtatcccagacatcaaatttaatttcaccgaagttggtgtaaaaggataaaggatgcacttcgacaccaatggtggcgatgtacttcttttcgaattcaccggtcaaatgtctcttgacaaaagtggtcttaccagtaccaccatcaccgacaagaactagtttgaatgttggaacttcaccgttagcagctggggcagacatttataatataaatgagtttatttgattttccttttgtactggactaaaaatcgattgagggaaaaatgttgaaggagcagttcttcctgtttaaaaacgaaacaaacttaaaaggtgaggaaaagttgatcatacagttcaaatttttcaaaatcttcgccaaagaaaaaagaaacgaaaattttttttctatctcggtgggatgagctttcgtccagagcgatattatcctaaggtgacgaaccacgcatgtccttcataaacggatcattatttatttaccaaagaagcgtaggtcatacttagaaagtaatagttattgaaataaaagaatagtagtaataggaaagataaagacgtgtctatgtacaattgtattttttgtttaaaaaataaattctgcattttgtgtggctgattacaaagagtgcgtagtgtattttgctttttctttattgtactggattcgaatataaaaagatgagaggaagaaagccaaaaataatgatcttgttcagcttgtggttctgtttgttttttcttcgacaaggaggatgctatgaaaagttcaatgactttctttggtttcctcagcatcatccaaaactagccaatcctcttcaattggctctgactcaccctcttcagactctttagcaacatgagcagtttctacattttgctcggtgtaagcctttaaagcctctgggccttgaagttccaattctggtagatttggtttttgtggtgggttccaaggcttaacattaccttcagcatcttgcaaggtacttggagccagtttggtgtcttttagttccctcaaatacaaatcttgtatgacgttgtaggatattcttgtggtagtgaaatttctattgcacagtctcaatggcagaactgaagcattgagcagtattcttctggaagcgatagggaacattttgattaggactggtacgcagacggttcaagtttgtatggactggtgactggtagatgaacctgtatataagttaacaccccttccttataacatctgagcagtgggttttttttttttctttgatattgaggacaaaggaagaagttggttggtcgggtaaaagaactacgctttttttatgatgcataattggttcgtgtatggcgatatgagaatcggcaatcaaatacaataccaacatacttgttttacataataacaagcagtctggacaagcttgatagactaataatcttgaatgatgtttaaatgctttttcgaggaaagcggcatttgaagataagcgcaagttctcttacaataagctcgatttcaataaaaacaagtgtgtatgcacaagaggcaacagaacgtcaatgcccagaaaatgaagtatttcggcttttccttccaatgcatttttttttcattagaacgctgatcagctgtgtatagtttaattttattctcattttcattttacaattttaagagccgccgaggcctagaacgagaaatccgtttcccgctttttcttctccttacgtcgtcagattctatatgggcagttctcgcgttattcgtcatcaggcaagtaattatgcccaatcagcttaccaatgtcacataaaggaaccactattatccctttttggtaatgaaaaacaacactcttccggtacgacagccgctgcggcaattacttttccccaaaagctcataatcgatcaattaacgcgtaaacgaaaaacaaaaaaaaaaaatacgtaaattaggtcttcatacgagcgtttttttttttttgaggatcgtttgcatgtctagcgcggcaagcgtgtttacaggcattcgttgtgtgttcatgtttagaacaaatgctaagtgataattataactgaatcctactcataacaattgcacaccttgtcgctttcttttactcaagggcgacaaaacgagaacacatcctcgagctatagccgcggggcctgctgactcgaaactcgtcgggctttgcagccataatccagggcagtggccgcatcgttcgggtcgaatggagggctagctacttgtgatttccgaaaaacggactgcaaaaaatgaggaacaatagaacaccgcgcgctttcttttggggctgtctggagaaaccagtgaaaagtgcgcacgcgtattgcggcttaaaaagatacccgtccattcaagaatggccgatttaacagaaaagagtaaagagatgagttttgcgagatcagaaacaaaaacaaaaaggaaaaaaaaaggaaatttttttgggagaaggaaaaaagggttaagtctgtagagaaactccgtagttcccttctgtattactaattggttaccaagtaataaatacctgagagtagtaatatataaaagagaaatcgtataaggaccgtgttaaatttatatatattaaggaagtctttcggttggtagtgtgagataactaattctttttggagagccttcttctttgctctatcgtggtaataatctacatattctcacaatcgcacacgtacgctttctctctcacaagtaacaaattattctttttgcattatagactacgtacgataaaaatataaaaacagaaaatggtcgaaggtgattttgtcgatgagcaatcgaacattgccttactaagctccaaatccatgtgtggtgatcatcatagcgtcaagaatagcataggggatgagatctttaaattattgacaaagattttaaattcggatgagaaagcaagcggagatgtgcacacactcgtttctgggaccccggatctctcaaattttaacctcgataatgaaccactggaaaacatactcgctgttttcataatatcttttattattgtagtggttggagttttactacttgggttgattggcatgatattcatatctctccgttcaggcagcagtaatgataagaaactacagtccaacgatgaagaaaagcaagcacttgctgaaaaagcatgaaataaaaatagatataatagatggcaccgctcttcacgcccgaaagttggacattttaaattttaattctcatgatagtaacgatcgtgcacattcaattaattatcgcataccaaacattttttttcctttttcaattcaactaatctcaattttttaattttcctttttttatttcctttttttttattctcatcataccattttcattcgttgttgatatctctattgttttttttggcaaaatatagtctacatataatatttaataatctaatctgatagcgttaatttccataccgcctccttttatatccgttggcactcgacggtttccgtatgccgtcggaatgcatccgcttcttggactccttgatcgtggtttgcagtatatctacactgtaaaatatagaagtttttggaatggtgttactccattgtgataatatctttgggggttctagcttctttgggttattcaacctaggaaatggattgctctcgcacgtctcatctctggatcttgaagtttgcttgaaggaatggtgtgcagatttttcattggctctttggggtaatttgctggctttaaccaaatctcctatatcaaacctgttagcatccacaaatactttggaatatcctggtgagccatcgtataacaatttcaaggtatctattgaggtttgtgccagttctttttggttcattttcttcacatgcatgatgtgtcttttctccttatttgaaaggcatgtaacttttagcgtctcattttgactactgttttctctttctttcctgcctctttttccaatgtggcgtcttttatgattatgtttattaataatgtctcttgctttgttcctataatagtcagctgttatacgaaggtgattcttaccgaccaagtgcgatttacgaacgctcaacgtgtcatgggtcaaatacgaatgacagtattcacaatagtatctcgtcattgcctatctctttcctctccgttacttgagcaccttcatcgcctacactaggagctcatattatatcttcagtatagcaagaatattttctgttatccttaacgcttacccgcctatgtaccttgacacttgcggaaatctagtgttcaatgataaggtactgtgtggaacatatgaaagtgaaaagagtttgaaccgtttattatctctatacaagtgtctctattcacatataaaagagtgaaaataaaaataacttttaagattttattacctacatgagattagaaaaatcataactatattactcagcggctgtgcctgttgttgatcaaaagaaaagatccgccccttcgaacgtcttagtgccgccttttgcccgcttatcaattttctctgagggaacataacggcatttatctattcgacttccaaatctacatacacgtatatagatacatatatatatgtgtgtgtgcgcctgtgtgtactagcacttctcaatattataattcttccataaagttcgatcgtgacttcctgttgcacagttatcttaaataatagaataaaaagctaacgcagattcaagtggggcgttgtcaggcacacaaaaagacaagacaaaaagtagcgtactagacttacagttatgctgttgtgtaatagaaaagtccccaagactttaaatacctgttttatactgcatatattcactctgttaacactgggtgtgttagtgtccggaatgccgtcaaaaatggtatcattcgcctctcaggagactttgcagagaataaataatctccttcgagggtctgccaatcgagatgttgacattattgcagaatatttgaaaaaagacgacgatgatgatggcggcgataaggatcaccataacatcgatattgaccctttacctcgccgtcctagtttaacgcctgataggcaacttctaaaagtcggtttgcatggtgctataagttcagatttagaagtctgtagtaatttgactataaatgaggtactcctgaaatttcccggttctaacgctgcagacgctgcagtaacacaagctctttgtaagggtatggtgaatttttttaatagtgggattggaggtggtggctacgtagttttttctggcaaagacgatgaagatcatctatccattgattttagagaaaaagcacccatggattcacataagttcatgttcgaaaactgctctctatgctcaaaaatagggggtcttgctgtcggtgttccaggtgaattgatgggtctctatcgcctctttaaagaaagaggtagcggccaagttgattggcgtgatctaattgaaccagtcgcaaagctgggaagcgtgggttggcaaataggcgaagcactcggtgccactttagaactttatgaggatgttttcctgacattgaaggaagattggtcgtttgtattgaattctacccatgacggtgttttgaaagaaggcgattggatcaagaggccggcactatctaacatgctaatggaactggctaaaaatggttccgtggccccattttatgaccccgatcactggattgcaaaatccatgattgatactgtcgcaaaatacaatggaataatgaacttgcaggatgtttcatcgtatgatgttcatgttactaaaccactgtccatgaaaattaggaagggcgccaatttcatccctgataacgatatgaccgtattaacaagtagcggctcaagttccggggctgcactacttgcggcgttaaggataatggataatttccagaatcaagaagggggcgattatgaaaaagaaactacctatcatttgcttgaaagcatgaaatggatggcaagcgcaagaagcaggttaggcgattttgaaggcgaagcattacctaagcatatagaagaggtattggatccagaatgggctttgaaagcagtgaaatcaatcaaaagaaactctcaagacggaaattttaaaactttagaaaactggacgctttatgatccggcatacgatatcaataacccgcatggaactgcccacttcagtatagtagattcacatgggaatgctgtttccttgacaaccaccatcaacttgttgttcggttccttagtacacgacccaaaaaccggggtgatcttcaataatgaaatggacgatttcgctcaattcaacaaatctaatagttttgaattggcaccctccatatacaactttcccgagcccgggaaaagacccctatcatccactgcacccactattgtgctgtcagaattaggcatcccagacctcgtggtcggcgcttccggcggctcaagaatcactacgagtgttttacaaacaattgtgaggacgtactggtataacatgcctatattggaaacgatagcctatccacgtatacaccaccagttactgcccgaccgcatagaactggaaagcttccccatgatcggtaaagccgtactaagcactctcaaggaaatgggatatacgatgaaagaagtatttcccaagagcgtagttaatgctatacgcaatgtcaggggagaatggcatgcggtgagtgactattggagaaaaagaggaatctcctccgtatactaagatgtggggtaagaatggtactgtaatatagttcaagataatagtacgtaatgtagggagcctgcttctgtggtatataaataaatactgggcttgcgtttatttttaaagaatcaatatttacttttcattaacaaagggcatacgcccttaaaacaaaacaaaaaatccagatcatgcgagctttgcctttttcagtaagtttccctaccttgcagccgagacgcgacttcggaacgatgccagcatacgtatttaccattattaaaaaaatctgatggcttgatactgcgcgtttctttttatagcattaatacgcacacatacgcgcattgttgtttactataaataaaccgtggggacctgacccagtcatcctccctgtgtttacagtgcggtgcacacgagcctgagacaagcccgtaaccaggcgcgttgccgcaaatacagaggcgccccagacaacaccgcagtgtgaagcactgtcaatttaaaaccgtggcttgctggagatgcccagaccaaccctgttgggtttttctctcgagcacgccgttataattttagcgtgttccgtacctgtgtgcacatcaataagcggtgtaacaaacttgaacttgccatctcatatcgtcatatgagcagttgcagagaaaggcactttaaataaaaaggcgtggatgataaaaaatgtatataagttggatggatttttgggaaaaagtaatgtttttgcagacgttttaaatactccctcccttttcttagtaatttttattatgtattgactaagtcaaaaataactatagaaaactaaagtttacgagaggacccaaaagttttgaataacacgtgcctttgattttttgtttactttctttttctagttaattaccaactaaaatgctttcgcttaaaacgttactgtgtacgttgttgactgtgtcatcagtactcgctaccccagtccctgcaagagacccttcttccattcaatttgttcatgaggagaacaagaaaagatactacgattatgaccacggttccctcggagaaccaatccgtggtgtcaacattggtggttggttacttcttgaaccatacattactccatctttgttcgaggctttccgtacaaatgatgacaacgacgaaggaattcctgtcgacgaatatcacttctgtcaatatttaggtaaggatttggctaaaagccgtttacagagccattggtctactttctaccaagaacaagatttcgctaatattgcttcccaaggtttcaaccttgtcagaattcctatcggttactgggctttccaaactttggacgatgatccttatgttagcggcctacaggaatcttacctagaccaagccatcggttgggctagaaacaacagcttgaaagtttgggttgatttgcatggtgccgctggttcgcagaacgggtttgataactctggtttgagagattcatacaagtttttggaagacagcaatttggccgttactacaaatgtcttgaactacatattgaaaaaatactctgcggaggaatacttggacactgttattggtatcgaattgattaatgagccattgggtcctgttctagacatggataaaatgaagaatgactacttggcacctgcttacgaatacttgagaaacaacatcaagagtgaccaagttatcatcatccatgacgctttccaaccatacaattattgggatgacttcatgactgaaaacgatggctactggggtgtcactatcgaccatcatcactaccaagtctttgcttctgatcaattggaaagatccattgatgaacatattaaagtagcttgtgaatggggtaccggagttttgaatgaatcccactggactgtttgtggtgagtttgctgccgctttgactgattgtacaaaatggttgaatagtgttggcttcggcgctagatacgacggttcttgggtcaatggtgaccaaacatcttcttacattggctcttgtgctaacaacgatgatatagcttactggtctgacgaaagaaaggaaaacacaagacgttatgtggaggcacaactagatgcctttgaaatgagagggggttggattatctggtgttacaagacagaatctagtttggaatgggatgctcaaagattgatgttcaatggtttattccctcaaccattgactgacagaaagtatccaaaccaatgtggcacaatttctaactaagtcgccctcagtccgctcattttagctgaattttctaatgttatttttcatcagcaaaacttaacagaacgttaatttatctaccccttttagttcattatctcttttttatccaacattttacagagatctctcacttaagtctaagtaaagacattattttatatggtacacttatagaatatacgataataataataaaaactatgtaacataaccttcagaatttaatattagtttcctttttacctcattgcactaataaaaaaattctacagaatctccgaaaaagaaaatccagcttactctttttgttttcttcttcacacgtgagcttttccgccggcatacgttccgttccgtgtcgtcttgcataaaatttccgaatcacatgttcgtaaaacaaccggaagtgccccgaatataaagtcaattctcaccgctgttgtaactggagctttaaggtgttatctaaggaaggataaaagaacttaaacaacaacaaacaaaaaattaagttacaatgccagcattattaaaaagattattgtttcaagtgggtcctcatccaaacgaaagaacattcaccttatcctctgtttcaactgatgggcactatatttccttgagaccatttgttaagccaagcggtgatgagttatcttttcctttcgaatgggcctttgccggtacaaacgaaacagttaaagctaatgatcaaggaaacggtgtcgttactcaagatttcaatttctggttggatacaaatgtgtacttgaacgttccaaacacccatcgtggcgaagtgaacaccacttggaaaaattgggattctggttgtgtcgaggaaacaggcgctgtttacccattcggtgccgacaaagaaagcgtctctttcagagaattgtggcaaccagttgacccatcaagagaagatctagtcatcgtctcaccaaacaatgagaagttctcgtcgaatgctaggtcaattgtcctcaaagttactgacgaagcttatgatggtttggttattgttattggtagatggattcaagggtttttgtcccaaaagaataataacactattgaaggcttgaacttcatcagattacttgaaaaagattcaggtaaatctgagttcttattaagctacggtaaggaagtaaacaaaattccacaaagctacgaaaatttgaagaaaggttccactgtaaccagcaatgggttgaactgggaagttattgaatatcacgcttaataaaggagaataaatcgttttctactttcttctgctgctataataagcacctatgggatctatatagtatttttataacgatagactttataaaagaaaatacctaagtgaaaatttggtgaattttgagataattgttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaggtcacatgatcgcaaaatggcaaatggcacgtgaagctgtcgatattggggaactgtggtggttggcaaatgactaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccatacaatgccatctcatttcgatactgttcaactacacgccggccaagagaaccctggtgacaatgctcacagatccagagctgtaccaatttacgccaccacttcttatgttttcgaaaactctaagcatggttcgcaattgtttggtctagaagttccaggttacgtctattcccgtttccaaaacccaaccagtaatgttttggaagaaagaattgctgctttagaaggtggtgctgctgctttggctgtttcctccggtcaagccgctcaaacccttgccatccaaggtttggcacacactggtgacaacatcgtttccacttcttacttatacggtggtacttataaccagttcaaaatctcgttcaaaagatttggtatcgaggctagatttgttgaaggtgacaatccagaagaattcgaaaaggtctttgatgaaagaaccaaggctgtttatttggaaaccattggtaatccaaagtacaatgttccggattttgaaaaaattgttgcaattgctcacaaacacggtattccagttgtcgttgacaacacatttggtgccggtggttacttctgtcagccaattaaatacggtgctgatattgtaacacattctgctaccaaatggattggtggtcatggtactactatcggtggtattattgttgactctggtaagttcccatggaaggactacccagaaaagttccctcaattctctcaacctgccgaaggatatcacggtactatctacaatgaagcctacggtaacttggcatacatcgttcatgttagaactgaactattaagagatttgggtccattgatgaacccatttgcctctttcttgctactacaaggtgttgaaacattatctttgagagctgaaagacacggtgaaaatgcattgaagttagccaaatggttagaacaatccccatacgtatcttgggtttcataccctggtttagcatctcattctcatcatgaaaatgctaagaagtatctatctaacggtttcggtggtgtcttatctttcggtgtaaaagacttaccaaatgccgacaaggaaactgacccattcaaactttctggtgctcaagttgttgacaatttaaagcttgcctctaacttggccaatgttggtgatgccaagaccttagtcattgctccatacttcactacccacaaacaattaaatgacaaagaaaagttggcatctggtgttaccaaggacttaattcgtgtctctgttggtatcgaatttattgatgacattattgcagacttccagcaatcttttgaaactgttttcgctggccaaaaaccatgagtgtgcgtaatgagttgtaaaattatgtataaacctactttctctcacaagtactatacttttataaaacgaactttattgaaatgaatatcctttttttcccttgttacatgtcgtgactcgtactttgaacctaaattgttctaacatcaaagaacagtgttaattcgcagtcgagaagaaaaatatggtgaacaagactcatctacttcatgagactactttacgcctcctataaagctgtcacactggataaatttattgtaggaccaagttacaaaagaggatgatggaggtttctttacaataaagaagcacatgtgtgttaacgtttttagtatttgcttgttatgtaaatcaggaaaacttcgcgggatttggttggatgctactttccatacaataaatattatagatctaaaaagccaaattacaagtaaagattagtaaagctgttggaattccatcgttgataaaaatgttagttattaaatataaaagtcagaataggtgaacttggatttaattgttggcatttcgttgctgctagaggccataatattagatagccaggacatactagttctcctcgtggtataggaatccataaaatggaattggtgattctatgtgatatattcacattcttactacattatcaatccttgcacttcagcttcctctaacctcgatgacatcttctcataacttatgtcatcatctaacgccgtctattataatatattgatagtataagtattagttgatagacaatagtggatttttattccaacagtgtctttgttcgtctcagatatagtcggattgcccttttaagcaatcaatagtgttttatttgcaacaatgtcgtcatagtttaatatgtcctataagatgttaacttgctcaacattcaacaaagtttggtctcttggcccagttggttaaggcaccgtgctaataacgcggggatcagcggttcgatcccgctagagaccatttatttttaaattcgaccgtctgacagacggtgcacttattactttaattttttttttttttaattcctcgttaaactgagtacataatcagcaacaatataatataaaagttttgcttttttatgtacgtacaataggggtacttaaataaataaataaacaataaaacaatcaataaataaataatatacgatcataaattacgagatatatttcatagtcttgacttctccagccgaacgtcattaaatttaaggcagaaaagataaacaagggtacggtgtacagaagacaaaataaataataacctttaaaagattataacaatgttttcattatttcttctcatcggccttaattttatttaaggcagaaccatatttgaaccattcaatttgctcatcgttgaaagtatgggtcaacacagcatcccatggcttaccattctttggatgaactctcattgttacaggcttacctggagccaattcagctagacccagaatatcgattctgtcatcagggttgatcttgtcatagtcagctgggttcttgaagttcaatggcaatagaccttgttttttcaagttagtttcatggatacgagcgaaagactttgtgatgatagcgaaaccgcccaagaatcttggttccaaagcagcgtgttcacgagaggaaccttcaccaaagttttcatcaccaataacaacccacttgataccttggtctctgtaatctctagcagtgtctggaacacctttgtattcaccagtatatacatttttaacacagttagccttcttgttttcagcattaatagcaccaatcatatagttattagaaatgttttctaaatgacctctgtatttcaaccatggaccagccatagaaatatgatcagtagttgtcttaccgacggccttaatcaagattggcatgtctttagcatccttaccatcccaaggtttgaatggtttcaacagttgtagacggtctgaagttggagaaactttaacttcaacggtgctacggtctgcaggtggagcttggtaagtgttctcaccagcatcataacctctttgaggcaaaccatcaccatgtggtggtttcaacatgaactcattaccatccttgtcctttaatttgtctgttagagggttgaatctcaaatcacccgcaatggcgaacgcagttactaattctggagatgcaacaaaagcatgagtttgtgggttaccatcatttctagaagtgaaatttctgttgtaagaggaaacgatagtattcttgtcacctttcttgatatctctacgatcccattgaccaatacatgggccacaggcgtttgccaaaacgataccaccaaattctttgaaggtttctaattggccatcacgttcaatagtggctctgatttgttcagaacctggagtaacagtgaaaatggtcttggatttcaaaccatgagcagcagcatccttgacaatggatgctgaacgagacatatcttcataagaggaattggtacaagaaccgatcaaaccgactctgacatccaatggccagttattagcaacagcaacttccttcatcttagaaactggagtagccaaatcgggggtaaatggcccattgatgtatggttccagagtgttcaagtcaatttcgacgacctcatcgtattcagcatccttatcagcagataataggtccttgtggtataatttagcaaagtcagcgatcttaccacgaccagttgcttccaaatattcaatcatagatttgttgaatgggaaaacagatgtggtagcaccgatttcagcacccatattacaaatggtacccataccagtagcggagaaggtgtcaacaccatcaccgaaatattcaacaattttaccagtaccacctttgacagttgtgataccagccaatttcaaaataatatcctttggagaagtccaaccgttcatcttaccagtcaacttaacacctaagatctttggagccttcaattcccatggacgacctgccataacatcaacggcatcagcaccaccaacaccaatagccaattgacctaaaccaccagcatttggtgtatgggagtcagtaccaatgatcaaagcacctgggaaagcgtagttttccagaacaatttggtgaatgataccggaacctggcttccagaaacccatgttatatttcgcagtggcagaggccaagaaatcataaacttccttgtttagatctatagctctcttcaaatctttttcaccaccaacttgtgcttgaatcaaatggtcacagtggacagtgactggcttagcaacctgtggtaaaccagcggacataaattgtaaaatagccatttgagcagtagcatcttgacaggcaacacgatctggtcttaattttaggtatgaaacacctctctgaatatcttgaccatgagggtcatccaagtgaccgtacaaaatcttttccgcgtaggtaaatggcctgtttaatctttttcttacgatatccagcgtttccacattctgcttgtagttaataaaagaatgatcttctaataagttttggttgacttttgaatctctagtcaagttggagactgtcgcaagaccacgaacaatgggtctcttgatggcagaacgtgcagacagcattgtatatctatagtaataatggtagtatttattaccttcgttctactatgtaataactaagaaagagtgaacagaacaagggacaacggaattaagcaacatactcctcctaattaacctctaaaaccggaagattatatatataacaaaagattttccttgtcctccctttttgtgcttgcctttccgaaaaccggcagcgattggaggtttgatggttaaagtcgcctgcggagaacaactgaagggttcaaatttttctcgtatgcactaatttctctattgattggtcaggacctttgccgatttcggcgccgaaatgctcgaaaaacaaagggtattgcccggccccgcggacctcccttttgcggctctcggccattttttaggtaatttgacaccgtgcccaaatggcttggcacaatcgagaatcaggcacccgcgtgtgaccggcgtcattcattaaagccagataagacaaagtaaaatacaatggattatgattaatacaatgatatacaaaaagagagaaaataaacgaaggctacgtctgcgtaattgacgatgggaaactggtatttttatataagcatatgtaaagtgcgaagtatatcagtacggaatgccatttgtgagcctttggaattcatcataacctttagtgaatatactttcataacttttacggattagcgccttcatatatagtgcagcttcgtgatcggttttttgaggttgaaatcttgctcttagattcctaattgtcttgtgacccttaaagcaggggagaccgcttcctaacataggatttacacactcaattatggcctccacgtgcggacgggcggctagatatgccttgatacaaagttcttcaaagtccagatacgctggggtctggggcgaacctcccatcactttaaccatttctttcgtcagcttgaatggtactgcttcaaacttgataccacctgggacaatatcaaaaataaacccaaaatcgatatgtagacaatgtccttgatcatcgtacataatgttaccattatgtctatccttgaattgcaacaaatacgaaattacgctatatcccgctaaggatttaacaaagttgtttcgtgcgttttgaaattcgatagtagattcattaccaaatttactagtgaaatattcatataatccattaacagcttcacgtcctaacatatcacgggataccgaattgggtagcacatcgatgacaccacaacccggtgccgtcgcagtaactctgtagggaaaaacgtagacatccaagccaatactagaccaaatggttctaaatagcgagatcaattgtaacgctagaacatcttgcctacagtcatcaccgactttgaagatagcagcttgccatttttcaacttccttgtttttacctgtcaaaggatcttttacgtctttctttattttaaaggtcgccataaaaggcgcctttgcgtgagattgaagtggcttaccactcttccgatcaatatcaataactacaccgtcaggattagaaggtaaataaacatcaggtttcacctcaattttgctcatttcttcatcgatcttatgtttcttttcagccttacttttttttatgtatggtttcaacttaccagatatgccagttacttcgtcgaagaattcaaattcacgttcgtaaaaatcgcgatgagattggctgaaacttgaaaccatacgctccctaatacgatctagagttggtttgatttcatcttcttgtataccttcatcatccttgtagcagtttgcaagcatattccagattatttgatgagaaaataacacactaattttcgcagtatccaaaatcaatctttcgacatatccggttttatcgtatctcaaacattgtacgatttgaggaacatagaagaatgccaagttcacatcttgtgattccaacgaatatatgctgaattgtaagataaaagaattaccttgccattcgggaaggaaaaggttgatagattttaacgggctcactggcgcccagtataaggttgcgtgtaggtctttcttactgctcaggtggcttccttttatgaacaggtcaagagcacttggggaccccacacacattaaagcatgttttgcaactaagcccactaaaacatcctcagctttcttgctataacatcgttgtaagagatttattgctaatgttggatctttagcaaaggtagcttcaacgatatcgcttgtaagctcgttgctgtcggctccttcaatcttctcagtcggagtaagccaggtttgaatctgctggatttcgcttgccaagaaatagttcaggatcttgtaatctttcccgcaatgacgtgacattagcgagcttaatttgttgagctgaaggaaaaggtccctagtaacagataaatctgctttgattttcagctcatttgagccgaatggccacgctactggtcttttaaaccaacttagggcaccgtttgtgatttcttgcgacaaacggcccatatacttggatccctgcttataacttgcgtttagtacgagagtcgcgaataacaataattcgtggcgaatcattctagcgaacgggtgtagtgaagccttatacagattcttgataccataaagcgcacatttcgtgaaaattttcaataaaaagtcactttgaaatagtgtgccctcgaaatgggaagcaaaaaatttaataacatgaagatgtggttgcatagcttgggatgcattttttgcatctctgttgatacctgctttgtcgtaaggggaatattccattttttggtattcttcgccctttaagtcatgatcgcgagaatagagaccaatattgtcatcaatggagcgcatccagcaatagcatacttcaactaaaagcaaatgtgcaacttcgggcttctcagttatgattgttaaccatacgtttgtagcaatctttaaagatgcagaggtgaagacttcgaacgggatgtgcacaatatcatatatcaatgacgctggtgcaccattgccaagaattaacaacgcggtagccatatcaagaaaatcagttacgtctttagttataatcttatttcctaaggtcaaattttttcttatgttttgagtggaaatacctatttgccttttgatatcctctggtgatgatgtaatagcggtatcgaaaagatattttgacctccaagaatgtaaagatataaatccagaaatcgtgttaggtttctctggaccataataagtaagccttgataattccttatctgcaggtaaaatcaaaccagccatatccatggcaaatgagacaccaaattcaacagaatttagcctgctgtactcaccgagatctgatatgtatgattgcaacaaaatcttagtatcctggttgcttctattcaatagaattcttacccattctttagctgacttgtgcaatcttgatagtgtcgtagcgcgccaggacgatgagcttggaaccaatattgttgtcttagaatgttttaatttaaattcataccgtggttcaaatttatgcgcctctgagtccaagatactatcaaatagggctgttaacatatctaataaggtgtagagagacaaatgatgacataacgatgatggaatagatctgataaatatttcacaggcatgaaaagcggcatcctgcaaagttggttccctatgagaaaggcaaagtagcaagttattaagttgttgagcaatcattttggagttgaatatggcatcgttacccttttgaatcaacctagcatattttctaatcatggaaaccgacaaaactgcaatacacttctcaattgaaccggaaagaatggaggggtctgagaagtacagtagagtcttcgaacaatcacctgcctcgcatcttatcgtttctagaagaacggcagccgctaaaaacatgattttagacgatgaagttgttctgtactgaacaatattggtattgaaatattcggttatctgctgtttttgttgtttgatattttcgttagatgaaccgcggcgcaaaattgtattcatttccaatgaaagctccttgttattagcaggaaattcagaagccagcggtggtgaattataggcaatagttaataagaaagaaaaatttcgtttgacaataggcccgcccaagtggtacccatggatgacaaaattaaaccaggcgttcctaaacttgtttgtagtgacttcatccttattgatgtccaatggcgtatcgcctggaacaggtagtagagcggcgaggggctctaagtaggtagcgatttgatcagcaacacgggaaatctccgtttgaggtctgtgatgttccaatcgttctacttccccactggcaatgattgagtccaatagatcatgaagatacatgaaatataagtcacttgaaaaatgcctggccaacaattcttttgatatcacacatttcgctttaataatatttttcaatagtgcgctatcatcaatttttgttgcaataacagttctcgatttgaagaactttagtaaaagcgaaaattctgtcagtgaagtattcggagccagtcttgccaaagaattcaaaataacaccgtctaattcctttgacatagaattaactttttgcgtaagaatagagatagtcaaagctgttatgctttgggtgttatagtatgaggcgattgtagtcgttgcagccacacaattagatatcaaagaggcatggtatgtcatagtagctccactattgacatcatgggaggaaagttggcccacagttgtatttccgagcagagcaccagtgccatccaaactggcagatgaatttcgcaagggaaagtagtctttctcaatattttttccagatgttattgttaattggcgctcacggagcaccgggacgggcgatccgtcctcggaaacagctaataagttgttcatggaataaattgtactcacaattgcatcttcatttagagggtataaccctgtggtgaatatttttgcaacatcattaactgtttcagtcgtgatatgtggagacgctaccaataaaggaaacatacgaatcagagttaatgacaatttttccgtgaaaaaattcagtaatgaggcagaagctacaattgcttttatcaaagatggtgtaacgacatcagataagaaaaatttatcaatagattcagaaacaacgtttgtaaaactttcaaaaagctcgctttctgtatcttctataaacggaattaaacatagcgtttgtaggtagtgggctcgagtatcaaaagaaaatcttgcacggttgtctgtagataggtcgagaatatgtgactcagaacaaaattgcagggaaattttacacatgtctgtaaaaaactgtttattgcttcttacgttgaaaaaaaagtcatcaatacacttcgtatcatcgttttcatcggctacttcttgatcaaatttgtaaaattggtattgttgatttagtaagaactcactcaagttggcgccgacatgtgaagtgtttaacagatgagatattagcgaaacttgcaagcgagatattaattccaataagtaggcactggatagctcatttccagcatcgtaatactggacgattgaatcattggtaaacgttgctgaggaattcaaaatcttatcaacttcgtttagaaatgatccacgaagcacaagtttcgctaactttttccaggtgaatttagtaagctctgtagagttgggaaactggataaatgcattaataaagcccactaatgatagtagaccagattgtttaatagtaaaaatctttaatacacgctcaaaataagttgaaatgatgccgcctatattttcataaagaacgggatactgttcacaagcttgaatcataaacttagtcagctggaaagttagcaattcaatcggatttctcatctgttccaacttgaatttcgaggacagaacatctgaaattctttgtcttggagtttccagaaaataaggcgcaattatttctttaagcattgtctctaccagatcgagcgtggtagggattgcaacacaaagcgaagttagtacttcccattcactcaatgtaagtggtatagtatatatctttgacgtatttgtggaataaaaaataggcaatgtatgagttatcaaatctaatgttgtaccattactgttttgatcatttggtgcacccgtcgaaagtttagttagtcttccaatagctttcgctcttaaagatgaagaggctttcaatcctctggtaaatctcatctgccttaaacgagtggcgttttcgattgctgtagttatctttttgtgatctaatttttttcttgatttacaatagttattaatgttgaatatgttttttcccacaactcaaacatcttcgcagtattcttgaaaaaaaaaatactattaacgtaccttcatccctgcgcgtgccgtttgatgatatcagccaaaaggtaaaatgagatgaaaaaggccaatcattcataaatgtacttagagacattaaagaatcagttagagaatataaaacaagataataaaaatggtacgtagatgcaactatatctttccgtttctcattggcggtttttagcgatcgaaaatactaacataatctttttggggggtgagaatgtatatgtgtactggatatgtatattcttggctttattcaaatagttgaaattacgccaattacaaaagaaaaagcaaaaagaaaatgaaaacagcagttctattcagcctaatttatcggcagcaagaattcgtttgaaaagggaccttgattcgctggacctcccaccaacagtgactttgaatgtaataacatcaccagatagtgcggatagatcacaatcgccgaaattggaggtaattgttaggcctgatgaaggatattataattatggatctattaatttcaatttggattttaacgaagtttatccgattgaaccaccaaaagttgtatgtttgaagaagatctttcatccaaatatcgatttaaaggggaacgtttgcctaaatattcttcgagaagactggtcgccagctctagatttgcagagtattataaccgggcttcttttcttgttcttggagcctaatcccaatgacccgttaaacaaggatgcagcaaagttactgtgtgagggtgagaaagaatttgctgaagctgtgagattgaccatgtctggaggttcaattgaacatgtcaaatatgataacatagtttctccttgagtcaagttcagagtaattttcggttgatttgattatatataaacaataaaattatagataattgtgacatactaggcgagttgtcgccttggtaacatcttgctaccgccatcttctgttagtttacgccttatgaccaacattccttatattctcgttcaaacttttgtctcgatattttgcaggtacctgtagaacttaatgtgttctattcaaaataagtataaaatttctggccagtaaaggcaaacaaaacataaagatattaatacgaaaaatttcttgaagaaaacaaaaaatacttcttataataaagaaacagcgaagccatggctattgacaagataatcaggaaggtgagataccctggatagaagactaagagagagcaggaagttgaagaacgcaatctcagctatcgctaattcttacaaaaaataaagatattacaactatggaagaaaaaaatgaatgactatactagttagtaatatttaacaagataacgctttctattttctgtaaaaaaaattctgtctcatgcacttggaagcagcttcaacatttctcttttccagatgtcacattttccggaccggccgtcattcaatcgcaattaaaagagaaaaataccaacaagtgggttgatttacttttgtgttttcaaaaagaccaatagttctaacaaagtagatgcttagaagtaagcaaagtggaatatagagaaacaaaattaagtgatagatttacttttacacaagaaaagagatgaaaattttcaatacaatacaatctgtgctgttcgcagcattttttctaaaacagggaaattgccttgcgtcaaatgggagtaccgcattgatgggggaagtagatatgcaaacgccctttccagagtggttaacagaatttactaatcttacacaatggcctggaattgacccaccttatattccgctagattacataaatcttactgaagtgccagaattagataggtactatcctggccagtgtcccaaaatttctagagagcagtgctcatttgactgctataactgcatcgatgttgatgatgtaacttcgtgtttcaaactttcccaaacatttgacgacggtccggccccggcgacagaggcattgctcaagaaattgagacaaagaaccactttttttgttctggggataaacactgttaattatcctgatatatatgagcatattttagagaggggtcatttgattggtacacacacgtggtcacatgaattcttgccaagtttatcaaacgaagaaattgtagcccaaattgaatggtcaatttgggctatgaatgccacaggcaaacatttccccaagtattttaggcctccatacggtgcaattgataatagggttagagctatagtaaaacagtttggcctaacggttgtcttgtgggatctcgatacttttgattggaaattaatcactaatgatgatttcagaacagaggaagaaatacttatggacataaatacttggaagggaaaacggaaaggtttgatcttagagcacgatggtgcacgaagaacagttgaggttgctattaaaatcaacgaacttattggtagtgaccaattgacaattgcagaatgtattggtgatacagactacatcgaacgctacgactagaagtaagatttccgagaaataaagtttctctctatatatctttgatctcttatttaattattcaactcgcaaaaataaaaagaatattttgttatttcaaaagtaaaaaagtatgtattagaatagaggacatatataaaaatcatatatatcgatgcttgaatgtataaggaaaagcgtcaaattatgaacggtaggtacttaggatgctgatgtcacataaagtcagagggtataactttaaaaagtaattttttagaatcttttagcgtcaaaacgttacacgtacatttgaacagtgttaagagtagattaattcaaattatacttttacgtgctccgatacagtctctacctcttcgttgtcagtgcaaataacaattggcttatcatgaactgttcttggagatggagaatatcctttcagactcgtaatattgatgacggtagttattctgcgacattgagtagtactagcatcccttataaccggaatagttgttgatgtaggtgaactttttgggacataacacttggcagttgtttgcaaattttttgtgatcattgatatgtttcttagtgacatttttgatgctattgtttttatagtgtaattgctatgagtttattttgttgacaagtatacttggctgtcttttttatataataacgaaaatgtgtagtggaaaagcaggtgtgttttgtcttatatcttacaaactatataggcttatatagttttttttcaaagattcttattactgcacaaaaaaaaataagatcccaaattgaacattaacattagtcatattcagggatggctcatcacgaacagcaaactgaataattttcttgtctgcgttcctttttttgtgcaccaatggatgtagtatgcgcacctgatgcgcataatagattgcaattacactgactacaacttacgtatatgcgtttttattacttttctattgcaacggcctaaaggaattcgataaaagaaagagtaggcaagataagcctgaatttggctttcggctgttatttttacttccgctaaattttctttgttcttccattgtttttttgcctttgtgttctccattaatccatccaattttaatgtcggattaatggaactttctattaacccataaatgccacatagtacggctgtagcagtgaaggttacaaaaggacgggtaacacatgagaaacatgcgtcagggaacaaactagatatttgattttgtgacgcaacgcaaaaattactggctattcttttgtagtattatcaaaatccatttaaaatattctctctccttcagtaatcctctattatttatcaaaaacccacagtgggtaaacaaactgcaaaagagttgttattatttctacggatcggcaattgaaaatgagaatacaactaaatacaattgatttgcaatgtattattgcactttcctgtctggggcaatttgttcacgcggaagctaatagggaagatttaaagcagatagactttcaatttcctgtattggaaagggcagctacaaaaacgccttttccggattggcttagtgcatttaccgggttaaaagaatggcctgggttagatccaccttatatacctttagatttcattgatttcagtcaaattccagattataaggaatatgatcaaaaccattgcgacagtgttccaagggactcgtgctctttcgattgccatcactgcaccgaacacgatgatgtgtacacatgttccaaactttcccagacatttgacgatggtccttctgcttccactactaaattattggaccggttgaagcataattccaccttcttcaatttaggtgtcaatatagttcaacatccagatatctatcaaagaatgcaaaaggagggacacttaatcggctcacatacctggtctcacgtatatttgccaaatgtatcgaatgaaaaaattatagctcaaattgaatggtccatctgggcgatgaatgctactggcaaccatacccccaaatggttcagacctccatatggcggaatagataatagagtaagagcaataacaaggcaatttggcttacaagccgtcttatgggatcacgatacttttgattggagcctccttctcaatgattctgtcataactgaacaagaaattcttcaaaatgtaataaactggaacaagtcaggaaccggattaatattagaacacgattcaacggaaaaaactgtcgatcttgccattaaaataaataagttgataggtgatgatcaatcaacagtttctcattgtgtcggcggaattgattacataaaagaattcttgtcctaattttcagggaattgaagaaaataaggaagaattaaattacaatttaaaaagaaattgctttagtattttatatatagacatgcagcaacttcttgatatatttcaggaagaaaaaaactgtttcaatatatacgtatcttctgctttcagctacatttttacttcagagacataaccagtcttttttcatcagtactgtccagttgtaacaacatagaaattacaggaagtaattggttccgttgttccttgtgctccaaaaatcccaacaaaacattttttatatatgcaattttttcatttttctcagagtctaactccaatgaacttgatgatcgtatcttctctaatttagttggattagagttattcgctggtgaggaatcaatattcgcgttagctagagtaccgatagaaccagacctactaactcttcctgacttgtcactgtattgtctttcctttaaagcattcaattgagaggacaatgaacgataattttttagtaatcgatcaaatttcttgttaagttcgttatttaaattcagaagtttctcattggcagactgtagctcaaaattcttttcatcagccttagacaatgagagttttaaattagatgtgatctgttccaactgatcggaatcatctgaagtggcttgagtcttccttttgatgtcattgttaacatgtttcaatgcgtcaacctctgattttagtccctcttcacgaagctttaaagcgtgtatttccgatttcagctcagttactgtatgcttccactcttgtaattcagtggcctttctggatgtttgtaagtctaattctgcttccaatttattcttttcatccgttaaataggccaatttattctccaactctttttgtttgctcgaatcatctgtctgactgtccgaaactaaccttctcaatgtgttagcttctctggttttgtcttgaacaatattagcatattcatttagttcatcttctaaagataaaattttttttgtagattccttcaacttgacatttagttcctcacattgtcttttgatagaatctatgtgttcattcgaattactttttacattttgcaaggtattgtatttttcttgcaaaatattcaatctttccgataatttaccattttctttcaaatactcctcgtaggaattagaattctttgcgatatcattatgcagtgtctcattttccttttttaataagtctaatctgttagaaattttagcatgatcttttctcagctgttctgtggatttttcagccacgtccttttgctcactaaattgtttaacttgttcctccaagtaactcacagttttttccttttgtttataagaggttcttaaagaagtaagctcctttgttatgtttgatttttcgtaggtaagttgagatatctcctcatttaatttggctaccttgttctgcgatgtagtctgctctttctccttttctgtacataaattcttcagatgctctactttcttgctcaataactctatcttacttctcaactcagtatttttagcttcgtaggcctcgatcatcgttgcatttttatggcgtaaatcatcgagctccagcttaacggttttcacttcttcattttgtttactcgaagactctttaatctcatcttttgcgtccacaagctcattgcctacagtcctcagcatatctctcacctcctctagctccgaatttttttctttcaatgacttcttggtatcgatcaactcggtgttaagggtttccagctcctttgctgatttttcgagctgtgagttttccaattctttagcatcttttagttctgcttctatatcttcatacttttgcttccaatcttcacaatctttatatttttcttgtaattcttgcaaattttctttaagcttatcatattcttcagtattgattgagttatcgaccgtttcctcttcactgatatcacccgtagttatgcctcccttatttttctttcccttgtttctattctttttccttctgttattgtttcctacattttgatgagatatcgccttcggtaactccttcatttttttttccaattcactcagcttgcgctctttctcttttaaagtaatatttagttctgccaactctgaggacttttcctccattatagtacttttcgaagacaaattttgctccaattcggttatcttcattcgactgtcctcgagagaatggttctttatagccaattcttccttcagttcggatatagatacttcttctttctgttttttggcctccctttcttcctttagtatattttccagtgcaactattttttctctcaaacctgaaacagtatcatttttttctttttgtacagtatccaattctatgtttaaagcttccatttttttttttagatcgtctatgtcatttttataattttgctcttttttcaaaaattcctcttctttatccttcagagtttcactagaggcgctttctggaatttccgagttctgcttagttaatctcttgatctcatcattcaataggttatttttgttgtttaaatcctggaaaaaagctggcaacgtatccactgcgtcgtcaatattagatatgggtgtattttccgctaaaatcttttcaacagcctctaacttctctgactttaatttttcatttttgtatgcggagagtagcaaagggtatttttgttcatatttctcaaattttcttaatttagcttgtatttcttttggcaagccactcttatcatcttcgatttgttgttctgacggggtagggctcatatcatcggctaagcccttcgctaattcatcggtaagattcttaccaatttgtgacagctgtttgaacattgaatcagcaaatgtttccctaagttaaaatcacctcaaatgtaactcctgttgcttactatttgacgtttctgctacatttggttctcttatattgctggatctgaaaatccgaactatgagaatgcgggtaatagcttttcatagaatcactaattgatattttttcaggtaataagtttcctctaatcgggcatttaaaatcttggatcgataacttaactgggtgtaataaaatatataaagatataaaatagatatatatatataaaacgaactttatcaagaagaactgcaaatgaagcgtactctcaaatcctcgaaaacgaaaaacactccaccagtacagtattatcacgaagaatattaagtaaaagcagccatcttaaataatagagtgtagcaatcaaacataaagctaaggttcttcttgattagcaaattgtataaacttttatcgaaataacctagaaggaggttttttcttacctagcttcaaaaaattgccatttttatcatctgtaaattcacttaggaattttgcagtttttgtaccgctagcagaagaagcatgcgtactgcctttggtgtttcctgatctcggttccacttgcagtgataattgatactgcttttcaatgtgggggacattttccaaagacgcttctataacggtctgaatatcatccaatcgtttcagcttgtaatggaatcttttaaagcttataatttcctccactatatttgcgattttagtcctcttgctgaagtttattatgttggttgaattgtgaagaaaatctgggtttccgacaaacgtaaatgttaaatcagataggtatacaccaaaaaagggaacacatgcaacgtccgtcacggatcgcaacagctctctatacttcacaaaatttctcttggaatccataaggttgtttaggttcttcagaaggtccttcgactcagtggaaactaaatcccatgtctttttcagtcggtagattggggaggaatacaaagcggacactatggcagtcattgaagaaaaattattcaactctttacaatgctgggcaacggtaacaaaatattgcgttaattttgaacgtgtcttgacatctgcctgttttacaatggtatgagaaacaaaattagttagcgtattagcattagctataaatttcgtaatgttcggagaaccacccatattacaatacttggtaccccatgccctatccaagcattcaaacatagtgatcctgaggtataagtcatgttcaagtacagtcaattgtgtggcatatgtgtatgggtcaatatccaagagcttcaatttcttcaatctaaaaaacgctgaagaagcagaagatggtaaagaagacgaagacatgtgtatcggtgatttattgtcacgtttagttgtctgtacgactgccgataccgaatcttgttgcttaggatccactggttctttctcattctcatttatcagtttttcatttatcttttgcaaaagatcctctgcccccggtattttctccgatacaaccatcttggcaaaatttagaatcagtggtatgccaggttcataataatttcttgtccaatactgcgtcaaaaatgttctcataatgttgaccacacggcatttaatcgggtttgactttttttctatccaaatattgtaatcatcgtaactcagcccttcaggaggatacaagttgtacctgtaaatcagggcataaaaaaactctcttgtggttaatatacttctgaaagttattaacattgtaacattgaaagccgcatcaacaagttcatgactggttaaatgttcaatcagtgcctcttttgtcccgccacgaatttttcctcttgagtcatagacaagactagtttcataatctgaagttaaaaaccatggaaggtttttctctatgttcgcagctttgcgttcaatatagtcctcagatcctaattcgtcatcgatgatagcttcatcattttctgaatcgtcatcactatagtcctcggaataaatatcaaaccatttttcttgctcacctttcaatagttctgcagtcaaattattcttcatcattcttgctgcgtagttcagcaaattttctctttcttcaatcaattgatcaacaataatacacgcaagattagaaatctcgacatacttttcacaagcatctttaaaatcgtcggagttgtttaaaaattcaaggttattgaactccacatcttgactcaccaatacgtgaaataaggagagtgccaattgttcattttttttatggaaggggcccttgaccaaaggtgtattagagatattcttgaaaggttcatgatgtccgacagggaaattggacctcattgaggaaaacaaatacgggtcgtctaaggtcgtttgttgcgttgtcattattaatctgatgacgatgtcatgaaaagcctgctttatatcaaaaaactctgttagtactgaggagaccgaagacatggcgtgaactaaaaattcctcgctttccaaatccaacaaaatactgggtgtcttaatcaggtttttcaaattgatgaaaattgacagatctaaattctccagtatctccaatagtaaaacattctgatttatttgttcgtatgtgcttgaatttatttccaaattcctaattctgcttttgggtttacttataatttttaagtgttcacctgtagcattatttaatttttcaaaaatttgcgaggatttcttcttcattgtattcaaagtgtctacagttaatggatattttttcttcctttttgaaactcttgctcttgaaaaggttctgttatgagaaggacggttgaaaggtgtaaaaactgaaccagacgcggcactgcttgcttttaaatcaatttgggaatttgtttctgaattagcgctatatcctgacgcagaggcaatagcatctgccatctttggtggaatccttgatattgaggaatttttggacgacgaagcggtcacttcattagatgtgacagctttgttctttgtcgcattaccaaattcatccgtaataaaagtcgaaaatggatttgtccaagaaccaccgctaaatgaacctttaaaaaatcttgggagcaactgtggtaaagtattatcatctgagaagactgagctctgtaacacaaaataaagtaactgaacatgccttaaaaatttcgagaattccacatcaaccatttcgtaaatcgatttagctgacttaaaatttttgttggacggtgaaaaatcttccaaagtagaattttgtattgaagtccttggtgttacgacagaattaacactatttcttggacctaagactgagaaattttccatatcgttctcattgactgtactgaatgatgatctcattggagtcaatgtatccgttgtactggtacttacattacgtttaccggacaatggaactgaaactagatcatgtacactatctacttcaattttaccatcatccccttccgtcctagaacaattattttcctgattatcgttatccttgtcattcatagtatccattttttttctgtgaaaagctgaatcgaaatataaatgagaattgatacttatccttgacaatgaagagattagacctttgaaaatcttcttaatctccttgctgcaacttttggctttaatttcatgttgcattagcctgcagcctaactgtgtgaagactattgaatctgatatcaaatcaaagtatttcgtgaaattgagacgattctctttaaggaacatcttgtgagccgttttagtataataaactgttaggtcttgtaattctgtccacaattttatatctcttgaatagtgataaaagatgtcactcttggccagtatagaagagcgacttggggcaactacccttgattgaatattctgcgttaaatctggagcagataaagaatttaatgatgaaggaccagcctcattgaattcgtttttgttattttcgttattattatcatcatcattaatactgttattatttccatcagtttcttttgaatcctgtttttccattagaaggcttgatctattttgttcactttccgattgcttcgatctcgtagaactgtcctcaatattcgcatttttcctcagatctctagtatataggttaacaagatgatcattgggcgggaattttggttcgctgtcacaaatgtcatcggattccataattgagttagaaatcaagggtaattctgaacagtatatatcaaggtctttgttatagtataccaacttgtaatcggatgttttcgttatcagtggtatgggggaccaagtcgaagcaatgttcgaacgtataccattaataatcatttctatctcttccaacggtaatatcttaattgtttcttctgctactagtgggggacctgctttctcaccagaagtttgtaaatttgtttcattgttattcataattgcgtttgtattcatctcagatgagccatctgcactctttgtcatatcctgggatagactagcattggaattaaagttcgaagattgaggggttatgtgggaagcatcgtttggcgctgaaaagggagaattattcatcgatacggtgttattgtggccggaacttgtttctgcattgtgggcatttgataaagacgctgataaagtagaactccccctcctgctcttgctcggatttctaggcacatgtaaatatgcactattgcccaagctatttaagctgctgcgccttgagctcttactggaactatattttttcatcggatgactgtgctttctgagatgactgtctcttaaaggtctaccgaagttttgaggaaaccagcctctgttaactttcccattactgtcgtcaataactaatccatcccaccacccagatgagtttttgttaagtatataaatggtttccccttgttgtacagacaaaagttgcgaagaactgtcttttttaatgggataattaaagtcataagcagcgactactattccaattggacgaatgctggtcaactcacttgtcgagggggaagaagaaagagaagctgaggatgattctgtgttagtggtagtggaagtgttagatgaagagctgatcgatggagtttgtgaagcattgcctgcctcccttgcagaacttgtattgggaatagacgtgttagtatcggacatgatacaactatccaatatccaccttgctttttcgttttattttttagtatttattcgaagaaaaatgtggctctttttattcaatttctttccgaaaaagaaacagtctatctaactaaaggaattgcttcacggtgatcaagtcactataactgtctccgccgtgttggtgatgcagttttctctgtaacttttgagcttatttttctattttattttttcctccaggtctctgtcaaagatccgtctcccgcgatgtttaaaagtcgttttagcgaattacataataacctggaggtgactgacgtcgactattttctgccccataaagcaacaaaatatttaactcataaaagcttcgaagaatatgtaaatatagtagtatgaatctaactgagtaaaaaaagggaataacaaaacaaaaaaaaaggaaaagagatggatagcatacgttatgaaagtaataaaaccttagagatagagatagagagagagagagagagagatgcaccttttctattctcaataaaaaaaggaaagtaagtgtaaaaaaatttaaaggagggatatatgacactcctactaagcagtcgtttttttttcttttgttaatttcattcttcatgctgggttttggatgatctagtgtttgcacttaaaataattttttttcctgcattctgacatcgctttatacatcctcgaatgctgtaatttcaatccgaaccgtttcagctgctttacaaaccagttggtatctttgcgaaccttaaactgaaaaactcggaatggtttcattgacttgaaacgaagcttgcgcaactgcaatctggatcccgaccaacattgttttgctttttggcaagaatgatcgaaataccttttaatatgtggagaaaattgcctgtatttattatgaagtagcacaaagagccttttccagcggcgtttctgttctttatgcaatacccttaaactttcttgagcggatttaaaagaattcttgagaaataggtgtaactttattcttcctccgtttattttgttaattctcttgtgccaaccgtctttcattcgagcttttgttgtataccataaaataactaagtctgttttgtatcgtctccagcccattaggtcatcatcctttaatgggtatgcaatatgattgtcgaagtcgacgtagtattttcctgaaggagcccactgacttaaagagtcacttgatgaatcgtaagattttttatcaacaaaatcgatattgccgtacaacagcttcctttcattattacgtaatgactgttgtgatttaaaacctgccaacacatcaccagtcagggaatattcgagggcgaggtatgaaaaggtcatggaaagcaatgaagatagcatgataacatgccacatcttcaatttagcagatttaccctcacttttatctatgatatgatccgatagtgtgctagaattccttatcgtactatccttcagtttcgacccctccatacttggcaataccgttccgccaacatttgagccggacaaagtatcaaatgactctgaaatagtgggaactccagtttgatcaatattaactccagcattactaaattcattagatgttctaaaatcgtaaatacgattcatctgtgcagactcttcactgctagtgttcgataggacatctgcatcgaagtcctcgtcgtcctctcctgcaaaggagctttcatgcaaactatccaaagatatttctgacttcgatgactgttcttccccttctctccctttacgtaatctacgtaatctaactaaattccaatgatcgtcttcttctgacattttaggtccgacaactcgactgttttactagtctctattatcgtcactgcgtattactctgctactgtgcttgttactttataccggaacagtagctcctaaacgattattccaaatgaagaaaaacgtttggccagtaacctgcataaaactgaataactataatgatactccgactaataatatatcccaatgccccatctcatctgtgtagatcaatttttatggctcgatccaggtaccttgataagcagctgtcgcgcaaaggggttaccgcaaaatggatagatggaccgggggcacaccggggtagggggtccggagggttaactgtcaactccacccatacaagaccgcgcagaaatcgtcgcaggaccccgccgaacggcgaaagcaaatatgcagccgtaaagacctaacaataaacctaatgtagtcatagggctaattgattttaaatatatgacctagctgactattcaagtttgccctaattgatgagtttttgaaaaaaaaacaacttaggtttcgctatccaagcttatgctatgggaagcgttggaaaacttgcatatagtatgaacaagagcgagatataaaactataacggtagatggaaagtaaagagtagacaagctcggaaacatggaaaatagcatgatgtttatatcgcgttccttgcggagacccgttactgctttgaactgcaatttacaaagcgttagaacagtcatataccttcataagggtccgagaattaatggtttgagacgagatccagagtcgtacttgagaaatcctagcggggtactctttactgaagttaacgcaaaagagtgtcaagacaaagttagatccatactacaattgcccaagtacggaataaatttatcaaacgaactgattttgcagtgtttaacacataagtcgttcgcacacgggtcaaagccatacaacgaaaaactgaatctgctaggagcacagtttttgaaactacagacgtgcattcattcgttaaagaatggttcgccggccgagagttgcgagaacgggcaactttctttgcagttcagcaatctgggaacaaaattcgctaaggaattaacgtccaaaaacacagcatgcacattcgttaaattacataatctagaccctttcatattttggaagatgagagacccaataaaagatggccacataaatggtgaaaccacgatttttgctagtgtcttgaacgcatttattggtgcaattctgtcaacgaatggatctgaaaaagcagctaaatttatccaaggaagtttgctggataaagaagatcttcattccttggttaacattgctaatgaaaatgtagcatctgcaaaggcaaaaatatccgacaaggaaaataaagcatttctgtgaagatacaaaaaatatagttgatggttcactggccaaaaatgtataaaagaaaaatttatctgtaaatagtgatcgaaataaaataagataataactaaagaatatatatgactttactgtacagatctataattgaaaaatgacgagaggtcctgtgaaagagtctgcctgttcgccatcttcacacattcaaccaattccctggtgcgcttggttacttccatcaggatatctgctaatttttgatagaatcgtttcttcccaagctttgtggaatcgcatccataagtacacaattccgataacttttgcgagcaatctgtgagcctttcaataatttctttacagtgctcgcctaaatccagtttaaaacttttttggaccattgctttggtagtcatatcaatcaccgattccaaaataggaataatctcgatggaattttgacataatctcgaaactgatcttgcggacttgaacaattttgatttagaggcttgaacatcattcaaaatgccctgcctgccataggaagaacaaccattgatttactctcaacaaattcgacgaggttatttatgttagcgttgtgcgtggttgagttgacatcagaattattcaagttttcttctgaagtagatattcttaatccaagaccagagttgggagcaaatttctgcactttctctctgaatttcctcattttggtcacggttggcgagtaaagtacgtctgcagctggcggaatatttgcatacggcttcgccgtttctgccactggtttagtgataactttcttcggaggtgatgcctgataatcctgccgaaatttaccaattagcggcaatgtgttaccttgaggacttggacttctcgagttcgagacaactttcagaggcaaaccttctcgcggagatggctcactcgtaattcttgaagaattcttagtgttttttaacggcgacacagacgctaagtttgtttctccagatgtattatttcgtaccttcccactctctcgaatagaagattcagatttttctatgatggaaattgatggcgatgctacaaccactggcatgtccgatttttttgtaatgggcttaccagaggatggaaaactaacagcagtactaccgctatcacccagagatgatatatccttaccgtttttctcatttttcactttttcaataatcttcaacggtttcatacctgcctcgatatcactgagttctccttcattgcgtgatatatcatcacgtgaggtggatttgatcttcacaatctgagcaatattgcagaacgcaaaaatcacttccgaaatagatgattgagctacaattcgtggtattaggtccccatatgtgagaaaatatcttgttgaagtgatagcatgagataaagcactctttaagtatactatttcgttttctaaagaactttgcagtgaaactgatgataggacaggtaagagatcgcctatcaactttgctatcttaattatagtctcaagcagaatcggcaggcgtgtggtggtggtatccacaggatcaattcgatggagcgtgttttgaaaataaagtgtaaattgagtttttaattctcggaagacttcaatggatataataccattcacgctcataaaatcatcgtttattttgaaggattcaaataatgtgtcatttaaatagaaatttagatcaccctcgtctaacccattgttatgcgtccccatatccaaatgatgtaagtttctcctttcaatttccgtgaaaatatcaagaatcaatttatggaacttcgcgtccttcaatcgagacagtttagattgtgctttacctcttttcagatcaagatcatttagtgatgcatccgcacccgaatctgtcaatcttttcatcaattcatcgttgacatcagtcgtcagttgccaaaattgtacattcgacaattttgtcaggtctttatttctattttggcggttttggttccttcttctatcatcttctggtacagaggcctctataattcttttgaaattcttataatccgatataaggtctatgatttgatcattcgttaattctgagctaatcattctttttatttcgttatggccacattatgatattcttttactttactgttttaattttatattctgcgattcaaatcataacagatatttagttgaataactctgtttttcttcatttccatttttttctatttacccttcttctttttattttacgcgtctcgcgttttatatattaatagtaataatatttaatagtgtatgtttgaaatttttatatgtctttatttcgctaacgtaaaaatcccttcttctttgtagggacgggggagtggttaacattgggagaagcactatttattgaaagttctagctgttttttcttgtcctccaaagcttttaattgtttagttaatttttccttcatttctttatgtctagcaaacaattcagtttctgatttttgtagttttttctccttttcggaaactttttgttggaaaactgttttcatttcaatttctagtttggctagttttgcctcatgtaaagttttttcttcttgttgtttagatattggatcgaactctttgaaaactgaattatcttgcttaataccaagttttgccaatttagaagacctgtagttttcgtatagtatcttgcttgtcctttcctttaattcctccatgaattgcttgatcaataaatttttcaaaaggttgaaatcagagtggttgtcattgtccacttcgatcaccccccatggataggaacggcctctcacttgattaccactgtagttctctacaatatcgttggaaccaataacagcataaggtaaactactaaatagtctttcggataaatggctattttctgcatcatcgttggaataaattggaggcttgaacagctcgatattagattggattaactggttcataatggtcttcttgaaacttaagatctcttcatcagttaagatgtcagatttagcaatgacaggaatcaagttacatttttcatatacagattgcataaacttcaggtccaggggctttaagtaatgtcctgtaggttcaatgaaataaagacatgcatggattcttttatcgtttattgaatgtctgttgattttgttctccgcatccaagtattgatcaaaacgagagtcaatctccttaatgatcgggtcccatgatttttgatcattatttaaaaaatcaccaaatccttcagtatcgatcacgttcaaattcagtttaacaccattttcttcaataaccgactcatatgacttaattttgaccttgtgcctttgttcttgtgattggttctcgtgaccctcgccctgaccctcctcttcttcctgatcatttgcaagttcctcctcgtaatctttcactaaattggcctcaatatcatcattattaaataaagttttcattaaagttgtcttaccaataccatcagggccgacacataggagattgaaactgaatccgttctttatggaccttctgtgccattgcttgggcaaattagcaaaccctacataaccattgatttgacgacgaatgaacttaatctccggttggtcaggcagaacttgacccttttcgctctgagaggaggtgatgcccataccgaggccgggttccacctttacatcggattcagctgcctcaaatctctcgctgtcgtcattttgcgtaccgttcgtgtactgcgagtccactccatcatgatcctgcgactcttgtttgatctgaacatcattgaattgatcatgctgacgctcttcttgttccgggtcctgcttaatggacacttgttcctcctttaannnnnnnnnncatggcaacgtattataggccgatgtaatcgttcagttgtcgtgtgatcctggatttgatattttcttgatctgctttcctcgagagattttaacttaatacacaaaacaacacaaaacgcaattcctaaaaccgagacaaaaaatggcaaaaaatgggaagcgaaaacacgcccccaccatatcattacacacgtagatcataaaagacgaaaatactaaattagccgcccaggtggttcctttttacgaaaggaaggaaggagaaatctagaggtgctgctatatatgtttgcaaggtgcgagaatattctgtcacaattatcaagcagcaagttatataaagttgtttctcacagcttcttgcactcccttgcggtgcctttcctgcaccactagtgtaactgctgatgtcttccatttgatgtcagaatcgatttcttgttacgccacgaacagttaatatatagaattaaaggaatgatcttgtacaactacaagataacaatagattaacagccaatattaccgtcgccgctgcccgcttcgcggagaaacagcgaaaaacaacgaagatcgttctcgaaaaagcccaaaagctgggtataacgcaacaaaataatcatagatttgacaattgtgctcccaatcttgctttgaaattaccattataaatgaactctgaacagctgctgcataactatgtttcggattcgctactcactactctgataagttttcaagagttcaagcagcaactacagtcgtacacgagcgacgagcaacaactgcaacattggtacgaattgcttcaggccagggatgcgcgagtgacctctgagttagaagcacgaatcaagcagtttttcataacgttgcgctctagattactgcgatttctggaaagcgagcaactatcacactcccttagcctcgagacactgatcgacgcgctgtacaagattaatgacctgttgcaacagcgtttgcagattctggatgatgctattcaggaaaagacctcggaactagcagaatttgaaaatatggttcgctcaccgagtgcaggagacaatgccattcctggcctattacaaattatacaatcttatattaatctattagaggaaaactagcagcagacatcccggtcaacctgccccacaggatattcctcgccgatccattgaaaggcttcgtatgttgagtttagctgtttgttatcgttcatgcagtacccgtcaccactcgttaattttaagctcccggtgcgctgcatctctgtaaggaagaccactcgtctcacacgagaatggatcagggccatggagcacattgagcacggctcatgggtcaaatagacgtcgtaatcaagacacagataagagtttgcgtcttcgtctacaccctccctgagtctttcgcctaccgcacggatgcccaccattacactgtggtcgatgggtagcgagttttcgcagtttctgccatcttctgccaccactttgtccttctttcttgatgggtcaacaaagacgctcaccattggaaactgttttcctgccgttgccatcttcacagacaacgtcgacgcacgcgatagctcatttcgtacttcctgcatgtctattttatagtcgttcaatatttgatcattggggttgccgttccaaatcaacggccagtacttcacagaccaggcattgttcagttcctttgtgctgggcgcaaactcaggcacttcgatatcatcactcagttcatactttttcgttccaacccaaatactcttcaatttattgtttatttcaccttcgtcgcaaatatactctttcgaacacaacaccacttccaaggtggaggtctcgatgtccttgcggatccttttcaaatgtctcaatgaaacagggtcatttttctgaaaatcgtttcgaattagcctactttactagttagtttacttccatgaatacaaaagcaaaaatcatatacatactctattactttcttcgagtctcttggatctattcttatactccatacattgactgcacttatatatgtttgaaagttagttaattgatcctgatttctgttagatctcatagatacatacttagtttgggcgtatttacatctttgaaatttctaatttgcagaagccgattttctattatcccgttctgataatcgatttttagcggattattaactttcttaaccataactaacacgccctcatgaatattatccttctgaggtttgaataatatatacctttagatgagctattggtgattcgcatttaggaatgaaaaaaagtaaagcatggcaatgaatgacacaagtgaaatagaaaagtgaaaaattaaaaaaaaaaaaaaaaaaactaagatttatactcatgaaaatcttattcgagttcattcaagacaagcttgacattgatctacagaccaacagtacttacaaagaaaatttaaaatgtggtcacttcaatggcctcgatgaaattctaactacgtgtttcgcactaccaaattcaagaaaaatagcattaccatgccttcctggtgacttaagccacaaagcagtcattgatcactgcatcatttacctgttgacgggcgaattatacaacaacgtactaacatttggctataaaatagctagaaatgaagatgtcaacaatagtcttttttgccattctgcaaatgttaacgttacgttactgaaaggcgctgcttggaaaatgttccacagtttggtcggtacatacgcattcgttgatttattgatcaattatacagtaattcaatttaatgggcagtttttcactcaaatcgtgggtaacagatgtaacgaacctcatctgccgcccaaatgggctcaacgatcatcctcatcatccgcaactgctgcgcaaatcaaacaacttacagaaccagtgacaaataaacaattcttacacaagctcaatataaattcctcttctttttttccttatagcaagatccttccttcatcatcatctatcaaaaagctaactgacttgagagaagctatttttcccacaaatttggttaaaattcctcagagactaaaggtacgaattaatttgacgctgcaaaagctattaaagagacataagcgtttgaattacgtttctattttgaatagtatttgcccaccattggaagggaccgtattggacttgtcgcatttgagtaggcaatcaccaaaggaacgagtcttgaaatttatcattgttattttacagaagttattaccccaagaaatgtttggctcaaagaaaaataaaggaaaaattatcaagaatctaaatcttttattaagtttacccttaaatggctatttaccatttgatagtttgttgaaaaagttaagattaaaggattttcggtggttgttcatttctgatatttggttcaccaagcacaattttgaaaacttgaatcaattggcgatttgtttcatttcctggctatttagacaactaattcccaaaattatacagacttttttttactgcaccgaaatatcttctacagtgacaattgtttactttagacatgatacttggaataaacttatcaccccttttatcgtagaatattttaagacgtacttagtcgaaaacaacgtatgtagaaaccataatagttacacgttgtccaatttcaatcatagcaaaatgaggattataccaaaaaaaagtaataatgagttcaggattattgccatcccatgcagaggggcagacgaagaagaattcacaatttataaggagaatcacaaaaatgctatccagcccactcaaaaaattttagaatacctaagaaacaaaaggccgactagttttactaaaatatattctccaacgcaaatagctgaccgtatcaaagaatttaagcagagacttttaaagaaatttaataatgtcttaccagagctttatttcatgaaatttgatgtcaaatcttgctatgattccataccaaggatggaatgtatgaggatactcaaggatgcgctaaaaaatgaaaatgggtttttcgttagatctcaatatttcttcaataccaatacaggtgtattgaagttatttaatgttgttaacgctagcagagtaccaaaaccttatgagctatacatagataatgtgaggacggttcatttatcaaatcaggatgttataaacgttgtagagatggaaatatttaaaacagctttgtgggttgaagataagtgctacattagagaagatggtctttttcagggctctagtttatctgctccgatcgttgatttggtgtatgacgatcttctggagttttatagcgagtttaaagccagtcctagccaggacacattaattttaaaactggctgacgatttccttataatatcaacagaccaacagcaagtgatcaatatcaaaaagcttgccatgggcggatttcaaaaatataatgcgaaagccaatagagacaaaattttagccgtaagctcccaatcagatgatgatacggttattcaattttgtgcaatgcacatatttgttaaagaattggaagtttggaaacattcaagcacaatgaataatttccatatccgttcgaaatctagtaaagggatatttcgaagtttaatagcgctgtttaacactagaatctcttataaaacaattgacacaaatttaaattcaacaaacaccgttctcatgcaaattgatcatgttgtaaagaacatttcggaatgttataaatctgcttttaaggatctatcaattaatgttacgcaaaatatgcaatttcattcgttcttacaacgcatcattgaaatgacagtcagcggttgtccaattacgaaatgtgatcctttaatcgagtatgaggtacgattcaccatattgaatggatttttggaaagcctatcttcaaacacatcaaaatttaaagataatatcattcttttgagaaaggaaattcaacacttgcaagcatatatatatatatatatacatatagttaattagtactaataatacatgaaatactgacagcttatgatgctgataaggaaaatattgccgcaaactttgtaataagccaaaagcactaatctcttttccgttagctttcataaaattagtgtatttaagtaaaccccggcccaaaatatgctctcaaatttgcttcatccttctgctttcttatcctttctacttcttcaaagcctcccgattttttcaggtttgaattacccacaaaattttccagttcatcatcaaattcattactagctttaagttttctttccatctcccacatcttctcagccttgtcaatagcttcgaccctactatcgtggtcagggtttaaagattggacggccaccataacttgctcccttacctgattaaatgtgcccggtctcataataggcaaaataggattactttttgatctcgaagggtttttttcttgttcttcacaacataacttaataagatcgaaagtttctaatgccttacccaagtcttccttcaaatctaaaatcaactcttcctgcaacgtgagaaactgttgttcttcacagaccttatcgagctcagcttcccaagtttttttccaatgtggtttttcagtatcaataaactcctgtagtttaagtacatctgcttgggcattttctaaatccttggatacggtttctagcttctttttagcgggctgagacctacgctcagcaacgtctttcctcataatttcgattacatcttgcaaatcatctactttacttagcagagtatcggataaatcaccgagttcggtctgtgatttttccatgtacattctgttggaagagtttttggcagaaaatgataaagacttaaagttatcgacctttcgtaaaatgttgaaaatagtctcattaatatttgacctattaatattatgcacttgttttattttccccaattcgtactgaatatctttgatcgttttatcatcatcttttttgttttgccccacaagatcgtgtttgttagcttcaaggccaggttgtggtaaaacttccgtttgcttgccgctaattgcagaaccaaaactcatttcttttaaatgtcttattatatcattctgactattcgatatctccatcttaactgtgtcaatgaattccttgatcgtattatttggattctcttcgagctttagctcgataacaaacccttctttaatatcgagaagatttagttcctctaattcatagaatactccatattgaggatccataatatatatgtctgggaaggaatttgctccaggagaatacgcaaagcgctcaataaataggagccttaatgcgttttttgtagtaggcagttgcacatgacacttctttgttttgtctcctatccttaaaaatactggacaagttccattcatggctttatctggcgaagttgtaacaacgcttgataatcttcgtggagatgcacgaacattctcaataggcaatggcgttttcgccaatggactcgcctttgatacatcgtcaatgcttttacccttattttcagctgaattaatgtttctatcatcatcattgttgttatttccgtataactttgactttcttacggtttcctctagatgcaacatcgagggtgaaggagttgtcatgaggccggcagccgcagcagcttctgttgtagactgatttgtcaatttagccatatggtaggcagagtatctctttgaggctctcctttgtaaattagttcccttcttcaattgtgaaagtgcatcatcatcatcagatgcgtttggagcattgttagatttaaggttttgtttaatattagttcttggttttgtcaatgttgcctctgctgactgagcagagggtgttcccgtagaagtagaattcactttttccccatagctgttttcgactgaatcgctttgcctctgatcacgtacaatactgctttttctgctacttaatggagtcccctcacgggtcccttcactacccaatgaaaggttactagtaaaggaagggttttgttgatgatgtgattttacacttatccgatgctcttgctgcatattcttcaaaattgcttgtttaacctttagtttgtctaaaagtgtcactataatctctctgatttttggcagatgtttatttaaagtttcatcagatggtggttccctcaatgtcacttccaatacacgtcttaaagccattggcacatcaccaacatctgacatgtcaactttcgcatgcatgaagaatttcgatacgactttgaagtcattgcccaactgaacgtatgcatcagatactaatcttccagaggttgtccccttagaccattgtgttaagacctggaggaggtgcttggtggacatcagcaactttgttactgtcgtttcaatactactactgctagaagcagttcttttaatctttggggtgccatacgtagggtcatccacggccatcttcatctaattttaaaataatacgaggattactacaccaatttggcagccagcttctactctttttcccttttcttgggtttgttttgatgccattatctcaagaatgcataatagtaggataaaattcgttcagctcggctagcgagatatcttcaaagagtaaagcgcatctgcgtgtaaaattaaattcaagaagtgaaagaataaaagataggattgtagatttgaagtttagtggtagcgtcagcagataagcttatggatgttgatgaaccgaatcctattgtgatatcagattctgaggccactgatgaggaaattagtatcatatacgaacccgaattcaatgaaaattatttatgggcagaggaaaacgtccaagaagcaagcagatcacagaaaattgtcactgagaggttgagcctggattccactgctggagaatcttgtactccttccgtagtaactgatacacaagttactacggggcttcggtggtctttgaggaagaggaaggctattcaaaagatgccatacagtttagaacgcataaagcataggcagttgctagagggctatgatatctctagttttgacagcatttcgaatcagttgaccttaccgaagaacgcttctacagtgattcactcaaatgatattttacttacaaagagaactggtaaacccttagatgagcagaaagatgttacaatcgactccattaaacccgaaaacagctcggttcaatctcaaagatatgatagtgatgaagaaataccaaagaaaaggcatcgtacttttaaagacctcgaccaggatatagtatttcaatcaggtgattctacggaagatgaacaagacttggctagtacaaatttacagaatactcaaaatgacgaagtaatatttagaggaagagtattgaatgtaagaactggttaccgtggggtcctgccaagagttgcttgggaaaagtcgttgcaaaagcagcagtcttcaaaagtcacgaaaagaaaaactcaattattgaaccataagggtgtggctaagaggaaaatgaacagaagcgcccatattgaagatgaagaacagaacttattgaacgatcttattgcacctgatgacgaactggatatcgaggaaaacgcccctccagatatatacttaggaaatcttccagaggatcgtgaggctaacgaaaaggaattaaaggaattgcaagaatattatgagagcaagtatagtgaagacgcacaatcggctggaacttctggttttaatttaaatgaggaataccgcaatgaaccagtgtatgagctggaatatgacggaccggggagctgcatatcacatgtgtcttataaagaccagcctattatttatttgaattcacggcattcagatagcggatttagtgagcaatacaatatatctgccgaagataatcaaagtgtaatttccctagatgctgctgaagagcataacgatggtataattgacaagatgttggttaaacctaaaagaattaaagcaaccaatgatgccaactttttgaatacaaaaagtaagagagtgagaagatataagtacaaatatcgaaattcttgtctggccccaagtacaaaagctatcaaagtcggaaaacggtcagcgcataaatctcatttggcagctaataatccagtttcatttgtttctaagaagaatcatgtaattgatgattatttttttgaagaattagaatctcaatccctagaacaggatgacagctcttctctcaagccacagaaaaaaagaaggaagaagaaagcacctatatactcaagtttctccgctgatcttgaatcgagacgaaaaccagttttcaatactgttgtagaggttcccacgaaccgatacgctttcacaaagccaaatgtacgtaatagggacagcattaatcatgacatggaatttgaggaagaagactccaatcaagagcttggaccaataatggtcgtacttgactcaattttactaaaaaaaccttttgagccacctaatttcttcaagatccagttgtcagacaagagtttcttgctatcaaaattgaatcctgcagatatagctacatcattacagaaaatattcagagtaatcattgataaaggtatcactgatactgaactagttcactttaacgaaagccttattgcttttttggtgcaccttgacatgcctgaactattcgacttaataggtgaatttcatcgtgaatttagatcgaaggtcaatagcttgaggaaaaaagctaaaccaatccatttttttcaaattgcggcatgccaattaatgtttctagaaatatcaagatataacaaaatttcagccgctgcaaaattcgacatggatgtcaaactcttagatcatattgtgtctttcttcaaattactttctgtctgttatgattctgttatgaaaaatccaatgcaatatctgtacacaagttattatattctctctgctgtcgttgatgtcatacataaaaaggaagctttgtgggatttatttcaaaagcaccccttttcgcctcatatttcactgttgctggtcaacatatttcctacgaaagtctgccgctggcaggttttgagattagattctgaattccaacccttgagttcggcatttcggttcatcaattattgcattgagacttgtaattggaatgttacaaattctttgattctttctctcgatcgcatattcaaacggagaagattttcggactttgaagaagagtctgatttgtcacaaaacaataagataatttatcctccaacgaatcagcttacgagtcgattaatgtttaacagatatttgcatctactgacgttgtgtgaattgtctagttctgatacacaacgtgtgataccgatgggtgatatttctatgaatgattctctatctgttttgaagaaccgcctcaacctactaattgttctagctacacgttttgatttaaacttagagaagcgcttccaagagctaacacgaccgttatatagtaaggaatatttaaacttgcatacacagaacacagtcaggacgataacaacattgatcatgcaggccagcctttcattcctggaaatcagtcgaatcaaaaatcatccattcagtggaaaatttattgcgtcattatttgataaactagtacttcaacaaccttccatatcgggagtaacagaaaattttttgaaagaattcacaaatttagtctccaaaatgaaaagaaaaagcgtgagtatgctcaaatttctgtatccttcactggtggccatgtctcaagaaaatatattcgagtcgtctttttttttattattacaggtatatttgaagagcttagatgtgctgggtccaacttgggtgcaaaattatctttttcagtttataaagagcaaggctcaagaaaatgaaagatggatagaatgctattgtcagatcggaaaattcctcgtagattctggtatatttacctggtggactttctttacctataacggcttagatgctgcattacactttcagcttgcatttcactcccttattatcgatttctgtgatacagactcttttgaattactgaaaaaaccgctttattccattgcttctgatttgctgctcatttccaaagatgacgctttctatcactttctttccaatctgttgaagagggcacatatcatagtagcagatttgaaacctgtttccgatgagaatgaactcctgcgattggcttatattttttctaaagcattgaaaaaaaatgcatatcaagatctattagctgttttcttatccctggcgaaaaaacattacgatgaaggggacatcagtagaaatttcttggcaaaatatctcgaatttcttaacaaaaattgcttgactgagctaagaaataatcaactcttcatcagtctaagaagggaacttggtatttcaagtgatgaagacgaaaaatgtgcgttctgggactcattcaatgaagcaggtgatatactttccaaagctgcatttgttgaaaccggtattgttcaagcctgttgcactgggaatgaaattgatggatatcttgacaatttaagcactttattcacctccaccatgttagagagcccttttgcatttttttctgacctggtgatagcacacatatttgagaacagaccttttttcgacgtgaatatcaagaattttcttctatctcacttcatagaccttttcaacaaggttttaaaaatgaaattcgagcaggtatctcctgatgaatttgctgaactttgcaaagtatacagggcgttatgtattgagtgcgcaacagacgacacctttaatagtaatagtgatttgatcgccgcaaaagatgcgtttttggtatctgtgttgagaatcgcagatgggttttgggagcatgacaaacttttgcagctaaggatgcttgatagtaatatgaacatacctaatcagattcctcatactactttgcaaagttcgctatctgcgattgtaataaagataatagaaagtaatataggaaaaattgaggcgtctgaacctttcaaaaccttcaagaatacgtaaattatacacatgtaatataagcatatttaaaaattctccgtaatatatgtcatatatgtcaaattgcgaattagtccaaatagaaacaagatctatcagtgttggtgataaacattttgtattcttttggtaacgtgtatctcaaagaagtgcatgactttttttacgttctctttagtcttgatttagttgcttctgcgtttgttaaattttttgtccttcccgtttgattaataatacttataataatacaattctgtaacaagaaaagcaaagttactacattctcattgtggtttctaagtcatctaatcttctcctgccccttctagataatctatcagtttctcttttcaatcttcttaagtttctttctttttcaatttctctcttttgtatttcttcttttgttaatatttccacccttgggcaccaattggagcccagttcatcaatatccagccttataccagataagtacccaaatgcggcatcgtttgggacatggtcctgaatcaagtggccatctacccagtccttctttatcttcaagatagtttcatgaagcgattgagatattaaggggatgaactctcttgttaagccaaggtcctgtacaatggatgtagcaaatctttctggagtaagtgatttgtcgttcaagttccactggaagttatcttcaaaaaatctgtcttgtaagttgcaggttaggttgattatcacgtggaggtcagacattatctcagtggctgcaatattttcgaggtctttcaactgctcttttattatattcgcaatttgagtttgtaaggtagcggaagtcatatcaagatctttacagtatatagaggcaaattcctccggagatatggagtcgtcattgtagttccagagaaactggtcttttatggtatgacccatatgttctatatccaaagtaattggtatcatgattgcctctccagaattggcgtttgccttcgtttcttgatcagtgttgagtctatatggagacaccacttttccgttaatgaaagtatctcttattttagggtatctcaatatgttgaaggggttgtggtgttggtcttgcagatccggtagaacggcgtttccaatatcctgtgcctgcgctttgttgctcggaccattgctggcgttgttattgctattcaaaccggataaagattccacaaccatgtttgaacccgcatcgtatttgttgttagagataatactatcagctccattcatgttctctaggacattgtattcggaaccgtccatggtaacaccatttgtaagtgccggagtattttcatgagacactgcattatctttatagtgtgtatcagcattgttgaaattagaaccgttcatattgaattcatcaaagagatcgttgtcatattccgcatagttgaccactttagcccttttatgctgccttgtttgttgagccattgtaaagatggggataccatcatcttcgtttgtcaatctgttatgaaagttagaaatataagcttgtggaataagctggttttggtgcgacattgtgtgctgctatgtgcctttcttctttcttttttcaatgtacttcattcaataatctctatttgtcgtattttctaagtttttttttttgttcaaagtagtcgcggcgactttaaatgagcagatcatcatttagtagacaaaaagacacgggacatcttctatctatatagtttacatactttattatgtgaaagagtctttcgaaattgcaacaatgctcgataaatctatgggtcatgtgctctataattcctgtacattagcatcgggtgcgtgtaatttttggggtgatatggcattctccatcaacttttccttttatttagcatcttctgtaagtcagatgctacttttgcactgccgtgggtctccttgtggcatataaagcatttggtgccctttttcatatctttggcaaaacacgatccacaaaaataatggccacagtttgtgaccactggagacttgtaatcttccttacaaagagtgcacttgaacggtatcttttccaagtctagagtaaccgctttggagtcctctttatccgcattccattcttggttcagcttccagccagtcttgaaatcatccctcgagtgtaagaacttgcagctatctccgtaaccacagtatcccgtctgtttgtaatctttgcaaacgtcgggctgaaaatccatcagcaccgtggtccggatattcgttggttggttaatctgtttagtgaggcgtttatttttaccgctcatgttcagtaccagctcattgtcatcactaggtcgcctcttctttgccttctcagccagctcttttctctcaaagtttagaagatcttctttagtgctgtcgtcgttgaccgttaaagtgtatttatctaaatcctcaccctttttctgtagtttaccttcattctcatgtgaaagttgaagtgtcctgctatttccactcttggctaagctcatgaggtcactggaacccttttcttcatcgctggccactagtttctcttcgctaaaattaattttctgcctctttttctggttcttttcatcagaagagcttttgttcactaatctctttctgaacatgaatacctggagctttgattaagtgatggagctttcgatggctttagcttgagtccacttcagatagagatgcgcatggctttttcttattattctccggttgcacggaaagaagcgggaagaggactaaagggtttttggatcagcttcacaaaatatatacttggatacgttcgctactgaggtaaagtgggcatgcaaggttgcaatttaggattcgagctgtctagttgatcctccggagtgtaaaaactgattttcaatgagtggtaacacaactaacgtgcatgagactagagccaagtttgcagagacgctgcaaccgaggattggtggcaatactacaaaagtgatacgagctgctttggaaaagaacgaagctgaaagcggggtgtctgaggataatgataacgggtcattggagaaagttaacgtagctacttcgccgcttttgacatcaacaccgcccacaatctcaaaggcgttggtgaaattgtacccttatttaattctcattgacgaattcctaaacgttgttacatggacaggaaagaatatttggagcagtgttttgatgctgtgtctctttattactaccgttgagtattttgaaacgctggtgaagtactttggacatcttgccatcattgctattttgtggggttattccctattggacaattatattgagggtacgttgagctcctcaccaacattagaagatattgctctcttaatgaacagagtatccttgaagtcagatattttgctctcccccatggttaaccttggaacgcaagatattcaacggcttctatatactacggtcatattatctccaatatacgtgatgataacctggctacttttaccaccgagaagcttgatgctgatggtgggcatgttccttttaacgtatcactcaccatggtctaaagtagcaagaaggcttttatggaagtttaagattgtcaggctgcttgttttctacgtcacgggtttagaccttggtggaataaataaggaccagggtatttttgctacagtgcagaagcaagtgaaaaagttggcatcaacagaaaacagtaatggcgtattatccgattccaagcctatccgttttacttatgttttgtacgagaaccagcgtcgttggttaggtattggatggaagcctagtatgttgagttatgagaggactccatggaccgatgaatttttgaatgaggctccctctcctgaaaacttccatctacctgaagagactaacactatggtttggagatgggtcgacaagacatggaggctagacatgactaatgacggtgccattcaagtgcccaattcaaaggcaagaacttccgcagatccctcccctgacgagggatttatatattacgacaatacctggaaaaaaccaagtaaagaagattccttttctaaatatacaagaagaagaagatgggtaagaaccgcagaattggtcaaaacttctgactttgatgaaagcgtgataaattcgaatagaaattctgccattgaacaaaaggttgaagaaaacagcacgaatggtttaaccgctgagcaagagcttgggagcaacaagcaagagaaagataatgcgaaaaaagtaggagagcctacaacagaagagacaaaagaatttgccgaagcatcaaacatcaacgaaggcgagtttgaaagaatttcctcgaccgatgaagaagttttaaaatctagggcaagagatcgactggcaaaagtattagatgatactgaagagaaagagcaatcaaatccaaccattggtcgcgatagcaagaaggccgtatgatgctcgctcccgtttttacctttacataatataatctctaatttactttattacacaaatggtaactccctttaaataaacttaaaaaagaacgtatagaactctcttcttcaatgaatagtaatccaattttttttattaactatacaacgttatgactttaaaaattaaaaaatatgtttatgagtagtaagaaaaacaaaaggaaacaaaaacaaaaaaagttataaagcctatttctacttcctgtataacgaacacaaatggatattattctttatgcggatgggaaagtattcttagttttttttgttccagtctcgttatgataacactccgatcattccttatttttcttataatctgttaaccttcaaagttggtggcaaagattggatcaatttcttagccttaccagcatcgttgataaccaaagtgtacaaagaagaagagcctctaaccttgaacttggtttgtctgaatggcttaccggccttgttcaattttttgttaatcttaacagtggcggtcttaacgtcagctcttctggtcaattccaaaaattgtttgatgtcggtgatttctctagccatttttccttgatattttgtcgtactatattcaacctgaaataaaaaactaacagttgaaatatttctacattgaaattagaaaatttaattctttagattgaagattcaatattgtgcaaaagcgtacagcagcaatcacgactctacatgccatagagcttggaaaactctccataattttccactcgaacgtatgatgctccgtctatttttttcaacagttgcacggacgagtcctccttttcgcaaggcattttaattgtgtgggtttatgaaaatgcacggatgcattttctctagatgaaaattccgtcttggaataatatcggaatgagctaaaagaacaccagtacgcgaatatgtgagatgccctgttttgtcacataacagcggcagttaatttggcgtcttttctgggaagcgagtttatttggcaaggctatgatgttttataatactaatcacgcattgcaacttcacaaagtagttgtgacatgtggatgtaatagcgttacttttctttttgtttattgctatttgtttctattttctttttttaaatcgcgctaatacgtggaaaaatgcgtagaagccgggaatgggacgtgattatgagatcataacatgactgcgagctagagagcattggaagaatttgcttttttgttcagttccctactcatatatttgtttcatagaagtcgtagtatacgtgagacaagagcacttgaaaataaatcttggatctgctgggagcaatatcatcaagtaaaataagggggaaaccatatcaaatgtcagggttcattaagagcacgttgcttggtctaggccaagattacttagaagatcaatatcaagagttcgcagaacagcatttccagccaaccagggatccgttttatgaaacgaataaagatggtaaaaagcaccgccgcagactgccatattattgcactaaggatgaaagtaaagcgtggaaaaaggtccaaaacaaagcctggctgcatgacaaatcactgtgcggatgctgttgctggacaaacactataggatgggcaccattacttgcacttctaccggttataggacccttattgatgtattgggtgcatgataagttgattgaattggcagatgacaggtataaattgcctgcggaaatcaaggtgaagatgcatggtaatatcgttatcgatttacttattagtttagttcctattctgggaagtgtttttgcatggttgcacgcatgttccacgagaaacgcagctatagtttacaattttgttggaaaaagggcattggaaagaaagcaagcggagctcatgcatcaaaaagaagaaaatgagaaacattccaatgccaatactgcacctccagtagttggtggcaacaaaaatgtgaatggaaacagaaataatagtaaaatgtataacagaccgcctgtgacagctccacctgcaccagcatacacgcgcagtactaacggtcgcccccaaagaggttacaggtgaacaaaccggccacggtaaggctacattcttatcaacaaatatgggcaatcaaaaacttataatgtaaattttattttttatcgtaaacatgtatttaagaagtaatataaaggatgtttgacatgatcattttatatatgcatacacgttattgaagttatatggtcgttaaatcattaaaaggcccgtttctttgaaatatgctaacggaatcaaaccggtcgggtcggttagatgtggtattgttgcaaatcagaaagccttctttcattgttttgggagttagagccccttctggtcttgttgaagactgtcttaatttcgccagaatcgattaagtcattaatctcatcgccaggcttgccccaattgcctttcccatagcctcctctcttgacgtggttgggagactccccaaagttgccgttatgggtgaaatactttgggttagactttgcttcgtggactgtccatttgctagttctggtcatgtttgaattgtgtttgtgttagaaatttgtgtgctttaatgttatgttataatgaaatcttattagatttatttaacgtttttgctgtgcttataataaacattacataataaaaggagtagaagaaagtggtagagaggagtacaaatctacctgccagaactctctccttatatatatttccagtggtgtctggattacctacctcaagccataccatatccataccatatccataaacgcctacaaaatttctaccccaatccagcagcttctatcactatctcgtataccaccataggcaccaccactgtttgtgtaaatttactcctgaggggggggtggctcaacacggtgtaggccttcttcccgcacaatccgatgaaaccccacaatcgcctccgtctcttccactgtgcacggcgctagctcaacatcttccccgccacatttactgtggcaaagaaggtgcataatctaaaaaaacatacgtatgagaatggaaagggcaagataatatcggaccgtagtgagtcacttgcttttggtattgcaaccaactgccgcccctcttcccgctcttgcaccaaaacgctaaatgcccattgtgatggctcatccaccctcacgacgaagtaagacccggggcacaagaaaatacgagatcataacagttcgagtccgtttattgtgtgcggttttggtacgctttttcgtgaggtgtactaccattcatgagagtcgttttaggagctgtcatgaaagatatgtatcttgttgatgaactgtaaaaatttgcagaaattgcgctattccgtttatttcattgtcgattcggtgttaatattaggggtacaaaatatactagaagttctccctcgaggatataggaatgcgcaaatgggcatttgatgtgacacaaaatttggacaatataacgattcatttttagatcgttgttcaaccgtcccagtggccgagtggttaaggcgatgccctgctatttcctcagaaaagcaattaggcattgggttttacctgcgcaggttcgaatcctgtctgtgacgctttttttaatttctttactccatgacaaaagcggataaaaattcccgcattcggcgtaaaaaaatccggttttttttttagcactcgctgtttttgcctctaccgggtgaaaaatgacgatgaagacggctggaattgcgctgcatccgcttacgtaggatagaacacctacaaagatttacgaactttattgctcgaagattcgctatccatatctttttagtttccccccatttcacaatgggataccgttgttttttctgtaggtacgctttctcatagttaatagagtcagtaattcatttcattttttgcagaaaggaatttcttcacctaatttagaatttcatcaacatttattgtatctgcatggtataacaaattagaaaaatttggaagggaaaaaaaaactgttgcgtcaattacttataccagggatagaaaaaaaaaaaggaaacatggatcccacaagagctccggatttcaaaccgccatctgcagacgaggaattgattcctccacccgacccggaatctaaaattcccaaatctattccaattattccatacgtcttagccgatgcgaattcctctatagatgcaccttttaatattaagaggaagaaaaagcatcctaagcatcatcatcaccatcatcacagtcgtaaagaaggcaatgataaaaaacatcagcatattccattgaaccaagacgactttcaaccactttccgcagaagtgtcttccgaagatgatgacgcggattttagatccaaggagagatacggttcagattcaaccacagaatcagaaactagaggtgttcagaaatatcagattgctgatttagaagaagttccacatggaatcgttcgtcaagcaagaaccttggaagactacgaattcccctcacacagattatcgaaaaaattactggatccaaataaactgccgttagtaatagtagcatgtgggtctttttcaccaatcacctacttgcatctaagaatgtttgaaatggctttagatgcaatctctgaacaaacaaggtttgaagtcataggtggatattactcccctgttagtgataactatcaaaagcaaggcttggccccatcctaccatagagtacgtatgtgtgaattggcctgcgaaagaacctcatcttggttgatggtggatgcatgggagtcattgcaaccttcatacacaagaactgccaaggtcttggatcatttcaatcacgaaatcaatattaagagaggtggtgtagctactgttactggagaaaaaattggtgtgaaaataatgttgctggctggtggtgacctaatagagtcaatgggtgaaccaaacgtttgggcggacgccgatttacatcacattctcggtaattacggttgtttgattgtcgaacgtactggttctgatgtaaggtcttttttgttatcccatgatattatgtatgaacatagaaggaatattcttatcatcaagcaactcatctataatgatatttcttccacgaaagttcgtctatttatcagacgcgccatgtctgtacaatatttgttacctaattcggtcatcaggtatatccaagaacatagactatatgtggaccaaaccgaacctgttaagcaagttcttggaaacaaagaatgatttgccgtccggaattgcttcgttctttctttcatctttctctttacaatttccaattttcccctacaggaattaattggagggtacaagcgagtagaaatgtgacatatgacttacctatctgtgttttagtatagtttttttttctgtagtataattcacttttacactaattttttcgcctttttctcttaaagagctaatttctataaccttcagcggttataccaaatataaaaaatggaaggaaaacaaacagtaagaaataagcgcaacagcacgttagttcaccattggattccaacatttcaaaatttaatctaatggcaagagatatcacatttttgaccgtatttttagaaagttgtggcgctgtaaataatgatgaggcaggaaaattgttatctgcttggacttcaaccgtacgcattgagggaccggaatcaaccgactctaattcattatatattccactgctaccacctggaatgttgaaagtatgtttctcctagcaaaattaaaacccatccgtgaatgaagcgttactaactataataactggtagctttgtcactcgtaccaggaaaagtgaagattaaactgaattttaaaatgaacgatcgattagttacggaagagcaagagttgtttacaaaattgcgcgagattgtaggttcaagtattcgcttttgggaggaacaactgttttatcaagttcaagatgtaagcaccatagaaaaccacgtcattctcagtttaaaatgtacaattttaacggatgctcagataagtacgttcataagcaaacccagagagcttcatacgcatgccaaaggatatcctgaaatctattacctttccgagttatcaacaactgtcaattttttttctaaagagggaaactatgtcgaaataagccaggttattcctcattttaatgaatatttttcctctttaatagtgtctcaattggaatttgaatacccgatggtcttctccatgatttcaaggctccgattgaagtggcaacaaagttcgctcgctccgatatcctacgccctaacgagcaattcagtacttcttccaataatgcttaacatgattgcccaagacaaatcttcaacaaccgcgtatcaaattctgtgtcgaagaagaggtcctccaattcagaattttcaaattttttccttaccggctgtaacgtacaataagtagcatgcataaaatataatttaatcaaatacttttgggcaattaaaattttagttaacaatagttatgcaatgcgctttatgttcatatgataccgtttataagctattgccatatccttatcttattgcttccagtagcctcgagtcgaccactaaaaagatgtcacttaagacggaaattatgtagctgcacttcttttttaacaagttcggtcggcccttcaagttctcctttctaaagcctcattatttattgcgtagatgctaaatgttatcgcggtttagcttgcatgttacgtttccgttttagaacctggtcgagtagcgaataatgtcttcagttgatgtactgttaacagtaggtaagttggatgcctcattggcgttactgactactcaggatcatcatgttattgagtttcctacagtattattaccagaaaatgttaaagctggatctatcataaaaatgcaagtttcacaaaatttagaggaggaaaaaaaacaaaggaatcattttaagagtatacaagccaaaattttggagaagtatggtacccataaaccggagagcccagttttgaaaattgttaacgttacgcaaacgagctgtgttctagcatgggatccattgaaacttggctcagcaaaattgaaatcactgatcctttataggaagggaatacgttcaatggtaattccaaatccattcaaagtgactaccacgaaaatatccggtctttccgttgatacgccatacgaatttcaattgaaactgataaccacgtcaggaacattatggtctgaaaaggttatattgcgtacacataagatgactgacatgtctggtatcactgtatgtttgggtccattggatccattgaaagaaatttcagacttacagatatcccaatgtttgtctcacatcggggcgagacctttacaacgtcatgttgcgatagatactacgcattttgtctgtaacgatctagacaatgaagaaagcaatgaagagcttataagggcaaaacataacaacataccaattgtcagaccggaatgggtgagagcttgtgaggttgagaaaagaatcgttggtgttagaggattttacttagatgcagatcaaagtatactgaaaaactacacattcccaccagttaatgaggaagaactttcgtactcaaaggagaatgagccggtagccgaagtagcggatgaaaataagatgcccgaggacacaacagatgtcgaacaggttgcatcacctaatgacaatgagagtaatccttcagaagctaaggaacaaggagaaaagagtggacatgaaactgccccagtaagtcctgtagaagatccattgcatgcttcgacggctttggagaatgaaaccaccatcgaaaccgtcaacccctccgtaagaagtttgaaaagcgaacctgttggtactcccaatatagaggaaaacaaagcggactcttccgcagaagccgtggtagaagaaccgaatgaagctgtggctgaaagttctccaaatgaagaagcaacgggacagaaaagtgaggataccgatacacattctaacgaacaagctgataatggatttgtacagactgaagaagtagctgaaaacaacataaccacagaaagtgcaggggaaaataacgaacctgcagatgatgcagcaatggaatttggacgtccagaagctgaaattgaaactccagaagtaaatgagtctatagaagatgccaatgaacctgcggaggattccaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggatgccaatgaacctgtggaagataccagtgaacctgtggaggatgccggtgaacccgtacaagaaaccaacgagtttactaccgacattgcctctccaagacatcaagaagaagatatagaacttgaagccgaacctaaagatgctaccgaaagtgttgcagtcgagccatccaatgaagatgtaaaaccagaagaaaaaggttcagaggcagaagacgatatcaacaacgtttccaaggaggctgcctctggtgagagtactacccaccaaaaaactgaggcctctgcttctcttgaaagcagtgccgtcacggaagaacaagagacaacggaagccgaagtaaatacagatgacgttttgtccactaaagaagctaaaaaaaatactggcaacagcaacagtaataagaagaagaataagaagaataagaagaaagggaaaaagaaatgattaatggatgccttcaatgagttccacgacgcacgtttattttttcgactgagaatccctcagcaaatataatctattttttatatatctgtgtatatgtaagcatgtataactagttacaaatatgataactgctttggcgatcacttcattttcttgagaggggtactcagtagccgccaagcacgaaatgtccgttattaaaaattggggagtgaatcttaaaagcccgaaaaggaaattcaaaatctgtctatttataggccgtcgcgctctacgaaaacgcgaaattattcaaacggaaaacggaaaaaaatctaaaaaaagaaattaattgagagatctcacggaaatgccgcgaggaatgtttctcgaggctgagcggcgtggtctgtgcaaaaaaatggcaatttttttgtaggagtttgcattgggccattcagaaggagcaccgttagatgggatggtaaatgaatttgctgtttcagatttgaatcaatctttacccgttatttttgccgttttgctttcataatctgcaaattaacaaagtcataaagaacataaagacatcaccccagtttttacactcttttttcctgtgtttggtttagcacaactttccaataaccaagttggtttcagatcatccccatattattttctagtttcatttacttaccaaactcaccattcaaggctttcaaattaagttacgagtacagtggaccatttttttctgattcttcatattttccgttataagtcttataaggaaggtatacatttatattgcgaatttgaaaaataatttaaagctgactttgcgttttaggtaggctagaaaagaatacaactatccctaaacacattctagattcacgaagacgcctctgcctcaaagacatactatatttttactctcgttgaacaaatagtaccattatttcgctactttcgttgaagattggacatataaaatacgcaaatcatagtatgttgtctttcacaaccaagaatagtttccgcttattacttttaatactgtcatgcatatcgacgatacgcgcacaatttttcgtgcaatcatcatcttcgaattcttcagcagtatctactgcacgttcttccgtaagtagagttagttcttcaagttccattttgtcatccagtatggtttcttcctcaagtgctgactcatcttcccttacttcatcgacatcaagtaggtccctcgtgtcacatacgagttcgtctaccagcattgcctccatatcgttcacatcattcagtttctcatcagattcaagcaccagcagctcttcctctgcttcttcagattcttcatcctcctcatccttttccatctcttcgacatccgcaacttctgaatcatcgacgtcttctacgcaaacgtcaacatcatcttcatcctcactgtcgtcaacgccgtcctcttcatcatccccatcaacaatcacttctgcaccttcaacctcctccacaccatccactactgcctataatcaaggaagcactatcaccagtattattaacggtaagacgattctctcaaatcattatactaccgttacgtacacaccatcagcaaccgctgattcaagcaataaatccaaaagttcgggtctttctaaaaaaaatagaaacatcgtcattggttgtgtggttggtattggtgtaccactgattctggtgatactggctttaatttacatgttttgtatccaatcatcaaggacggactttattgactcagatggtaaggtcgttacggcatatagagctaacaaatttacgaaatggtggtatatgcttttgggtaagaaagttagtgatgaataccactccgattcaccattaggtggtagtgcatcgtccgcaggtggtttagacctagatgaagcagatgatgtgatggagcaaagctcccttttcgacgtcagaataagagatagcgatagcgtattaccaaacgccaacaccgccgaccataataataccaatagcggtggagagcctataaatagtagcgttgcgtcaaatgacataatagaagaaaaattctatgatgaacaaggtaacgaattatcaccacgaaattattaatcatatccattcatatcatttagtgcttatggctacttttcattcctcaattattgtaaattgaccatcttaattatatttctgatattgagtaggtggacttcattagtatttttacaaatattatcaccttcttatgtaggattagcattacataccctctaattaaaaaaagttaacattaattacattttaaaaaaaattgtaatagtatgatagtaggacctgacagccatttgaataaggtttcgagtgctttaacgttccactgattttatgtagttcatatgggggttagtctggtttgaggaggagaatttcagggaagcagtggccgttgaatctccctgtagggcgctgattatttttatcctaataatccaaaaatgacaatgtcaataaagaaaacttaccgagttctgtgaatttctccctaaaaaattactaattatacctgggcgagttttgaactctttggcaaataaacttggggtaaacctttcgattataaagacgttactgctcaaaaatgtgtagaagcataaggagatattctctcgtatgtttaattggagttggcttttttggactctgaagtttgagtatgggaggggaagtaatcgagattagattccctgatgttcacatatggggataaagaatgctttttgggatatgattgtttctttccgtcgttacggttgtaggtgcaacgaattgcgtaagggtggctagccgagatttaatgacgacgcaaaagggaataactgtgacaggaagatgaattcacaaagtttataaaaagaaagggcgatgcactgctacatggttgaacaaggcactacataattcacagcttgtagcttgtaaataaaaagagcattcacgcgatatacgattttcaatgatcactctaagaggaacggcgaaaaatagaattcaatatgaactggaatggcaattatgatcagttaaatatacaatattgttgttgcaattgtattacatttaaataagagcatgtatgtgataaattactgggaatttatggtataggttccaaaacgccaccgcccaaaacattgttattaatgaaataagaatcaacgatcttctcaatcatttttatttaatgggtattgaaatgaaaggattgataatgtaataggaagatgattgacccagaaattatctcaaaattcgcctatttctcagttatattaacctgcttattttaactttaaaaaaaattggaaagtttgcattctacgttttagcttttccgtataaaaattagataatttgacgttcagtataaaaaacgtatcgtaataggtttgcttattggaacgttaaggaaaaaaataataaagaattcatttttttcctttttaacccacctctttcaatccacctatacaactcattattagtagagtattattctaccgttttatacagatcatatcgtgtcttttgctatgctaggttgaaacaaggtaagatacgttaaacgacaacggctatgttgcaggcgaatcgctagcgattatttaaaagatcgtaaactataactgagaaaataaagagacgtaatccaaagtactagcaacactcaacatatataattgtcaatactttaggaagctactatttaagatcaggtacgtagaagcagacgaacagattcgagtttcgatctcctttctgtattgtattggttaggttacatctcggtggaaggctgtcgtatctcagaatgagatacgtcagtatgacaatacatcatcctaaaagttcataaaacacacatgaaacaaccttataagaaaacgaacagagtgagtaacatgagataaaactccgccttccttggctgacccacccaaacatataaatgcctgaacaattaatttggatccgaggttccgcgcttccaccatttagtatgaatcatatttatgtagtatataggataagtaacatttcgtaaatcaagctgataatccattttgacaactggtcacttcctcaagactgcttatattaggattgtcaaaccaccttactatgaattgcgttttgacacaggaaacgctaatgtaatataatccgtgatagtttaatggtcagaatgggcgcttgtcgcgtgccagatcggggttcaattccccgtcgcggagatttttcattttttttttttgagccacaagaggtatagttcgacagaagagttctattaaagttttcctgttatttcatttggaatataacccaagttgcttttctttgatcataattatttccacctctttaatggtttgtttattggttgattatttcagcctttcttttaggttccttcgcattacattaaaccccgtaactaaacttaaactttaaaaaaaaatatggacaacttcaggagatagatacaataaagcatctttaaaatttgagcaatgctttgcttattaaccagcaaatgaagactatgaattctaattgctaaacatgttaatgatgctagaaagcaagacaatgttaataaataatacaattcatgcatttagtaagatgtaactgtccaacaaactggtggtacaaggatccttcactgcaattagagtagcgtacgaatgcaagaaaattaataattacaaggaatgttgaacaaaatcagatttgagctttggtaaaattggttatcttcctattattttggttcagaagcagaactgaatagtaaattttatcatcattgtagacaacattccacacttgatttaggtataactttatataatatcactttgaccgatcactaattttcttcaatattgataaacaatggaaataatgaaaatccaggtaatataatgggttaaaatcagatggtgatgcatgatgtaatccatggcacatattccaaaggaatcatcgccggataaaaaaaagacgattgtggtgtctattcatcaaataaaaagttccaaacatataccatttatcaatactatattatgaactcataataatgagaagaaaattattgaaccggatattttaatcagtgtcaaattcgtagcactttttgatgtagtctaagttggaaaataaagaggccagatcataaacgaagaattcctaattcacaatatgtcctgcatatacttcctcagaaaaatatttaaatcattttttataatcacgcttaacctcgatatctcccaaactaaaatcggtatcaaaggtgctcgtaaaggaccatcaaaaaatacctaaataacatcgacgataattggcaatgcttcctagcatacaaaagacaattatcacaacactttttaggcgtggctgaaaatagcagctatttctgccacttcaaaatttgtttggctggcattgttcttagcaaaaaaaaggatagcttttcatccaactcaattaagaaagttagaagatccttatatatgatgaagaaaaattttcttcggatgttggaagagaatgttcgataataatcgttacatacgattgtcactgtagcatttgttagggttcaatcatatatgataagcccaatttgagaccaaaatcgtacattggacaggaccgcatcacgtcagaatagtttttgtgcatctatgtaatataatacggttgaattatccttttataatgatgactatttaattattatatgattaaacaaaaaaaagaagaagacaaacaacttattaccttatttcttgattttatatttattcggaagcagcagctctggtatagatagcttgcttggaatgcttcgagattggcttgatgataccttccttttccaagtgcctcaaagcaattctggcaagagaaccaccaatctttaatctatcaaccaaaacggaaacagagacgtatctgtaagttggaacctccttcaagattctgtcgtatttttcttgatccaaaataacagcgtgttgagctctgtccttcatggactttttggaccacttcttcttggacttcttaccaccagcaagagcggcagcggctttggcagctttagacaattgttgctttggaggcatgttatattatgttctgagacgtaagaaagggtgaaaattgatgttagtgtcaaaaattatattacaaaatacgcagagatattctagttcctttgatgaatgaatctttcagaaaaaaaagtcaaagcaaaagcaaaatggcctgcagactaaactgtatggtggtcttggaatgataaagatctgtttaatagatttagtagatacaatagcacatctcattacccagttatgattgacgtcattctgagttacaatgatcttagcgacctgtgctcattatttgctccactaattctaattttcctcgcctttcatatttcgtatctttattctatatcctaaaatttttttggcaaatcccagatttggctttgattttggcatcggttcggttctttcaaatatcttcttcccgtgaatcaactgcacataccttaataactagttcagtttagtgctctgtctgagtgactgtaataataaattttacaagccacttctcatgacatatattggtaagtaacttcatcaatactaattagtctttgccggttacccatctggcccctgacttgcgatgcttaggaagttccatactcgcggctcttcccaacagtagcacatccgtgaaacttctggcgctattcattatgcagtaccaggacaagaagttaaaaaaaaagctctgttacaagttcaatggtggtgcaaggattgaagttattatccaggaggcacggatgcaaaagatagaagacaaattaatttccttaaaattcaaaatgctcattattgtcacgctgtatgagcatttggtgaagatttcactgggaaatgttgcaataatttgataatcgttcgtattggatgaaactgtaacatcatctgtttattaagtatccgtgttattagtatatcatcacatacggtgtaagaagataacataaagattgagaaacagtcatcaaatataatggaagctgaaatgcgaggattgatgatgtaataggacaataaaaaatataagacggaagaagaaataatcgtaatagcattatgtaaaaatagggatttgaggattcctatatcctcgaggagaacttctagtatattaactatacagaatatcatagccttgatcaacaataaaatcccagcaattatcaaattatccatccatttctcagtgacattctcactagatgagcgtttttgagaataatgctaacatttggtaaggtatgaaataaaatgcgatatcctccgtagttgtcgtccgatatagtgtaacggctatcacatcacgctttcaccgtggagaccggggttcgactccccgtatcggagatatatttaatattttttttgatttgacttcaaatgagaactatttttttaaagcatcgtgtggtaaacaagcttccaccgaatgagcttaagaaagcgcaaacaattttcaacctgacaaagcatacatcatttttcatacaagtccttgttaagtaactcaaaaaaatcattaacgagatggccaaaagagttgccgatgcgcaaatacagagagaaacgtacgattctaacgagtctgacgatgacgtgactccctccactaaggttgcgtcatctgctgtgatgaatagaagaaaaattgccatgccaaagcgcaggatggcgttcaaaccttttggttctgcaaaatcggatgaaaccaagcaggctagttcctttagcttcctgaaccgggcggacggcactggagaagctcaggttgataatagccctaccacagaaagcaattccagactaaaagcattgaacctccagttcaaggctaaggttgatgacttagttctaggcaagccgttagcggacttgaggccccttttcaccaggtacgaattatacataaagaatatcttagaagctcccgtgaaatctatcgagaatccaacgcagacaaagggaaatgatgctaaacctgccaaagtagaagatgtccaaaaaagttccgattcttcatctgaagatgaggttaaggtggagggacccaagttcacaatagatgctaaaccgcctatttcagattccgttttctcatttggcccaaaaaaagaaaatcgcaagaaagatgaaagtgatagcgaaaacgatatagaaatcaagggccctgaatttaaattttctggaactgtatcaagtgatgtatttaagctgaatccaagcaccgataaaaatgaaaagaaaaccgagactaatgctaaaccattttcattttcttcggccacttcaactactgaacaaacgaagagtaaaaatcccctttcattgacagaagctaccaagaccaatgtggacaacaacagtaaagccgaggcttccttcacttttggaacaaaacatgctgcggattctcaaaataataaaccatcttttgtatttggtcaagcagctgcaaaaccatcgctagaaaagagctcattcacgtttggttcaacaacaattgaaaaaaaaaatgacgaaaactcaacctctaactcaaaacctgaaaagtctagtgatagcaatgattcaaacccatctttttccttttccatacccagtaagaatacacctgatgcatctaagccatcttttagttttggggtcccaaactcttccaaaaacgaaacttcaaaaccggtattttcgtttggtgcagcaacaccatcggccaaagaagctagtcaggaagatgacaacaacaacgttgaaaaaccttcctctaagcctgccttcaatttaatatctaacgctggtaccgagaaagagaaggaaagtaaaaaggactcaaagccagctttttcatttggcatatcaaacggaagtgaaagcaaagactctgacaaaccctctttaccctctgcggttgatggtgaaaatgacaagaaagaagcaacaaaacctgctttttcgtttggaataaatacaaatactactaaaaccgcggatactaaagctccaacttttacatttggctcctctgcactcgctgacaataaagaggatgttaagaaacctttttcattcggtacctcccagcctaataatactccatccttctcattcggaaaaacaacagcaaacttgcctgctaattcttcaacatctcctgctccctctataccatcgacggggttcaaattttctttgccatttgaacaaaaaggtagtcaaacaactacaaatgatagcaaggaagaatcaacaacagaagcaactggaaatgagtcgcaagatgcaaccaaagtagatgctaccccagaagaatcaaagccaataaacttgcaaaacggtgaggaagacgaagtggctttattttcgcaaaaagcaaaattaatgacattcaatgctgaaaccaaatcgtacgattcaagaggcgtaggcgaaatgaagcttttgaagaaaaaggacgatccttctaaagtgcgcctactttgtaggtctgacggtatgggtaatgtattactaaatgcaactgttgtagactccttcaaatatgagcctttagctcccggaaatgataatctcattaaagctcctactgttgcggctgatgggaaacttgtaacttatatcgtcaagtttaagcagaaggaagaaggccgctcatttacgaaagctattgaagatgctaaaaaagaaatgaaataagagtaaatacagttaacaattttaaatagaatagaaccctcatattttgtagctcaaggttatagttgagcaaataaagaatacaaaatttattccaaaaaacactacgaatctatattttccagttctttgtctataatagatttggcagcttttgaagcccaagccaatcttctttcatccctatcaaaagctttatctcctttctttcctgcaaggaaattatggtatctaaatttcttgttaataaaccacttcaaacctttgagaatgaatagcatattttccgatttaacgttcttcgttaaaacatcgcgcaaataatcatcggagtagattatacgcttatttccactttcatccatcttgagtttcttctcactttttttagctacagttaaaaataactgaaatagcaatatctccataaataacatcccttctgtgtttaatccacccataaatggaacatgcttgaaaacatctaatttcaaaatgtcattagcaagcaacgatccaaaaaatctcccctgatttgagatgcgaagcagtttttctttatcatctaaatcatcttcttcgtcagtatcgctttcagaatcgaattctttgtcttcaaatttttttatcacatcccagaataggaattgaaacgacttcgataaatggctatacctttcacatattttgttcgcgaccaatgcgtagtaatgattataaccattggatccactatcagccaaaagacaatgtaaaacaattcttggaatttcaagaacttgcttatttttcaagcttaacttttcaagtttactaaatgcatccaggtaatcttgtgcagacataatacttataaatatagcccttcgaatgtcagtattcatacgctgttgtctggcgataatattccaatctggaatatcatcaagaagatcatcctcgattgaaattttagatttcttggacttgctggcatcattttcattattgatcgaaacttcaaaagcattttccatgtttcctcgccaagaagcaccaaccagccaccatttccccttggaatcaatgtttttaatgtcttccagagaaacctgtaaaggctcccaagaagaagaagaattcaaaatgctttgcaagtttttctttaatggatgatgatcagtcgccaaaatagaaggctttaacctgttgtttttcaagtcagacatggtatccattaaaaatctcaatcttgggctctgctcttttaaattcttggcgttcttcaacagttctgatcgtatatctctcagggcggatggatcatcaccccggatcagttgtcctgaaatcgatataattcgtaaaagtaactcagtagtgaattcattaggatctgctacaaatattcgaataatgtcatagattaagcgacacgaaacaaatccaaaattataacaatacgatagtaaggttgcaatattgatgcatattttagaggaaattttgctctgctgatcctttaatatattttccatttcctcttcgtaatgatgcagaaatgcctctaccgttttttgaatgaaaaaagcacccacctcaatacctcttagttttgataatgtatacgcaagagcagcataattcattataaatccgtccaacaacttctgattttggcttataatattcaatatccctttcgttaacgattctgtaacgtactgcctaggcagggaatcatacaatctgtttaaatcagtgataataatagtaatattggagtctgaaagcttattcaaagaggagttgaccttcttgctaatttcagacaaagtactattgttttcactatcatccaatttctttctcagtgatgggggaacatagctctctacagattgtgtgggagctacatagggattttccttttctcttctataattatcatccgagtccgcaacgctgtcgttatcagattcactaagcccatctgagtcttcaaaatcagaagctgaaagatcatcatccgaggaaaatgctttctcgcttgcttcatcatcttttctcatagaattagtttctgtggcaaaatctccatactcttcgtcacttttgccataattttcaaagtattccaaaccttcaagaagtccaccaatagcatcaaattcatcttttgcatgtatagccttcctttctcctttcaagcccaacttttttgcgtaatattgcatgtccatctcgtccctttcaaacgctgatctgtctgaaggggccagcggataactcacaaaattctcatttgtatctctgttacgaatatgtttcttttcatatgagttaccttttatttctcccgagttttcagctccttgtataccctttgctttccgtttcaatgattctagttttttcattgtttcttccgcagacattgcctgctcaccgctttcttctgctacttcatcagtaagcacttcgtcactatcccagttttcattactttctgattcatctgaagaaatcggatttttaccgttagcctgcttgcctacgtttttcacacctgcattagcactcctcttttcggacgttggtgctgattttagccggctggaattgatttctctagttgatataattttacgtttcttgtcggcccgttccatctttctcttttctttacggcttaaatgtttgccatttcctcgtcttctcttttttccttctgaaatagaaaacctttcatcttgactgtagtcaagagtcttcaactcgtccaaaataacgcctggaattctaataccatctgttttttgcattgcctcaatattctgcagctgtggactggctatctttagttaagatgaggcttcgtaagtaagttcagtagtcttgtaagctcatcgcattttttttttttgtctggattttatatttttcacagcgaaaaggacgggaagctaaaagattaaaaaataaatattgcagataccatatgtaatttagtaaaatatttttataaaatattattattttcttgttcttcagtgatttattgtaaccatggagaaatgctcacgtaaataatgttaagtccaatggcacactactaccctttccacttggatacagttttgttttattttgaaagggacgtggcttaggcatttgtgacacattagtccatttaaatcttgaatcatctataacaattctttcatttccagatttggccccaacgatagaattcgatccccctatcgtatacctacctacatcaacatctggttgatttgtatgcgtattatgcttgtgttgcagcgtcgatccacctgtagaaaataaccgttgtttaaggtttttactggggctattagaggtaccggtatccatcgtagatggacttggtggtgggggtggcgacttagtggggttcttcgaaattgattcagtttcggtacgaacggaaagtgtaggcgcaacaggaggaggtgatggtattgatgtagacacggattgctgaggcagacttggtgcactaaatgttggcaatggcggagcagctgcaacaggaggagaaggaggtttttcgagattcgaggagggaagaacatcgtgtaataaagaagcggcggggacattattcttgctatcatctgataaaactggtggaactggtggaggtggaacgtgtccaggcagtgcaggggcctttgcttttttcatccctaacacagtctcactcttatcattggtgtggtcatcacctgatgcagttggagtcggtagcgatgttataggaggaggaggtgcactaggaggcaaaggaggcgccatagcatccgtatgggggggtggtgcgttaaaagcattcgatgatgtttgcttatgtaatttggattcaatttcatccagaaacgacataccattttggctactctgtttaggcgggtttatagatggagaaataggagaaggtcttacgttatcatccttagatgaacctattacatcctcttgtttatcttgggtagtgtatccagtatcaccaccaaccacgaatctatcatctctcttcttttggatctcagcaagaaatggtaagggtcccccaggtgttacggccgaggaagaactggatgaagatattttggattgcttactggacgctgagggtttgtttgtcgtgagtgttggaggaggaggaggagccgatggtactgacgttgcaaccgaaggaggaggaggaggtggtagtggtgctaaaggaatagatgatgctgacaaggcagaggatgttgaaaaagcaccaggtggtgggggaggaggaggtggtggcgcgggcattgacgatgctttgttaggaggaactgatgtagtatttggtaacggtggtgctaaagttgggggaaccggggttgcttttacgctgttagtcgacgcagagctcatggctgctggtagtggtggtggaggcggagctggagctgaagttgcttttttaggtgcagaggtcacatttggtaacgatggtggaggtggtgcagtaggcggtaatggcggagcatgtgatgtaggaatgggcggagcagatgatggaagtggtggttgtgaaggagatttatgattttcggtttgaatctttgtggaagaaacgccctcgacggctcctcgttcagacctcctggcattaatttctgccaaaaatggcaacccgcctgcaggaacttcagaagatggtggtgagactgcgttatctgtaggtttaatgttttttgagtccaggccaattgttggagttgggggagggggtggagcttgtggagggttgctaacatgtgttggcagagacgctgaaggcaaagggggtgctgacacactaggaagagaaatattagagctttttctttggtggcttctgtgtgctggccttactgaaggcatatgcggtctattttgcggtacctttggagcagaggcacctgataatggaagcggtggtgctggagatgatggtacaatgggaataggaggggccgcagaagatggaatatcaggaattggaggtgcagaagacgagggaatactaggaacagcgggtgctggtgataatggtgcattaggaatggggggagccgcaacagatggcaccgcgcccggaattggcggtgcgctcgccgatggagagggtttagtgcttgcattgttattgatatgttttaacttcggtatacctccagctaaaatatcgcccaactgcggagcgcccatcccagggattggaggagctgacatagagggtcctttactactgacggtaccagaacttcctgaggccgatgaaacgacaccacctcccacgattggggcacttctatcattggtctcagctttctttagtttcattccctttctaatgtcacctaacagggcgtcacggccctgcatcacagattttgccggtttaggagcactaccacctaatgctggtggaggcggtggaggaggaggagctggagcacctgccatttcaacaattcgttatatatatggtaggcttcttcaacaaacggttgtgcgctttttagtcgtatgctttgtctcatatcaaaaactttcttcataagtttataattttagattttgttcaagtatttactgactgtgcggattattcttaaggcccctatttgaggacggcggccgcacccgtaagcagtgactaggttatgaacatttcattctttctaaagacgcttttagcaagcttcatacaggatagtaggatttgaaggctaacattgtgattccatcctctgtcaatgtttcgtaacttgaatatttgcgactttttccatcttttgtgagctaaaatttttatcttgcccttgtaatttgaacttaaaagagaatacagcaatgtagcggacaaaccgaacattgaaattaccattttaattgtaacttatcttgaaggagttccataccgtatgttatcaagatacttctcagggcaatatctacatttacatatttgcctgcttaacatccgaacatttcacattttgattatttcgagaaaaaagtcaaaaaatttctcaaagaaaaaagaagtaatgccgaactgagagtgaatgcatcacatcgttgcgaaaaactggtaaaaaatgacttcaagttataagtaaatgaaagattaacaatatctaattctcgattcttttttcaagtttcagccataagatacataagcggaatacctttaaacatcctgcaaacagtctaataaatacgtataataagtttgaaatgggaggcattcgtgaaaagaaagctgaatactttgctaaattaagagaatacttggaagaatacaagtctttgttcgttgttggtgttgacaatgtttcttcccaacaaatgcacgaagtcagaaaggaattgagaggcagagctgtcgtcttgatgggtaagaacaccatggttagaagagccatcagaggtttcttatccgacttgccagacttcgaaaagttgttgccttttgtcaaaggtaacgttggtttcgttttcactaacgaaccattgactgaaatcaagaacgttattgtctctaacagagttgctgctccagccagagctggtgccgttgctccagaagacatctgggttagagccgtcaacactggtatggaaccaggtaagacttctttcttccaagctttgggtgtcccaaccaagattgccagaggtaccattgaaattgtttctgatgtcaaggtcgttgacgccggtaacaaggtcggtcaatctgaagcttccttgttgaacttgttgaacatctctccattcactttcggtttgactgttgttcaagtttacgacaacggtcaagtgttcccatcttctatcttggatatcaccgatgaagaattggtttctcacttcgtttccgctgtcagcaccattgcttctatctctttggctattggttacccaaccttgccatctgtcggtcacactttgatcaacaactacaaggacttgttagctgttgccattgctgcttcctaccactaccctgaaattgaagatttggttgacagaattgaaaacccagaaaagtacgctgctgctgctccagctgctacctccgctgcttccggtgacgctgctccagctgaagaagctgctgctgaagaagaagaagaatctgatgacgacatgggtttcggtttattcgattaagaagtgcaacatgaattattaagttaatttcatatatactattttataattaaataacattaatcctcattgattcattttattcatgataatgtactgtccggttccttgcgctagcctgagttagtctccgaatacctggcgattttcatatattctgagcggctctggacacctaactggataaaaatacttccacttaatgtagtttggttttctagttcatacggactatttcaaagttcatgatttgatgagagaaagtagctatactatcttcccaatttacgcttgtctctgaacaaaggtttttatcctttatatgcttattgaaatactgagaataccaaaagttgtctttttctctactatcgcttgattctttcaagacgtcggatataagaaatgtcacaaaatcaaaaatagctgcgaggaaataatgaagaaaagtaaaagacgaaactactgcttcgatgagaggtgagcagaagctcccataaaaaaaaaaacctatcttgcagtatttctatgttccttaagagatcaatagaagtagaatatgtttcgaaggggagataattcaaattttaacgtacaaaatagcttctttcttcctttggaatacgaatataccgtaaaagataatgtaccttcaaaaaaaaagagtagtataggtttttttccattagatgattctttattcacatcaaaaaacaattcagggcaccataaaagcgaacagctccatcgcggtaatgcagaaactatcagaagccagtttggaactgacgcagttccgataaggatcgatgagaaagaaggaaagtgggatagaattcaagatgataattcttctaatttaaactaccaaattaacaacagtaatgacccagcttcgagtggtaaatatacccagagtattgactgtaaccatatagcggagtcaaaattttcaaaaaaaaatggaaacattgatagtcttcgttcaaactcagcaacttttatgctaaatactgcagatgaagacgtgatagaatttagttttgacgataatgtcccttatgctgagttattatctggtgccacccttgaaaaatgttcgttgactctaaatgaaataaacaaaaaactattcaatacgctctatgactttcgagtaagcaaagataatcccgaagaaaatttggtagaactaatacttccgaactgcgtggtgttattaaacttttttgaagacattgaactcttggccgactcttctgatgaggctttcgaaaaatctactttcattaacacaattgagttcattgtgcacgatatttgggtcgaaacgttgataaagaacataaacttattacaaatgtttgatgcagatttgaaatgctacaatgacaagtacataatttgcaagctaaagggtcagtatccctccacaaatatagtggacataatgtgccgtttgaagcatttttccaattctattttggaaactttcaaattcggaatcgagctaaaagaacaagatcaatgccacaatagaaacactattatcaactacgttcttttcagtagagtattttcaacgattgttttagagattcaaaaatgctttatcttgatcgttaagttcatgtattctgtcaattttttagaaaaattttccgatgaagtatttttgtcatttattgaaattctcataaaaattgtctttgagcaccagattccgcagttatttttgggaattgatgaaattattcaactctggttaaagaacaatgaaggaaaacggcaacaactcttgagcgcttggtgcaacggaactgttcaagatatgaagcaaagccaacaaagagagtcctcaaacgcagaatctgaatcaatcacttcaagtacagaagaggacgaagaaggcctgcaattcaataaatgggatgtgattgaaccatttattgataatatcaaggctttgaatcaatcaaaatcccatatgtgacgcagcgataaaaccgcggcatgcaaacatctacacaattagcaagggcaatccatattttgtcttttcgcgccctggaaaggcctaagtaatgtcgtaaacgcattctatctgtacttcaactctcctctgtgcattggtttgtgcaaatcacattttacgatactgccagatatatgcaaaaagagaaaaccaagggaccagaacaaagcaaaattacgatattcttcgaattccttcgtgcttgactaagacaaagggatggacgtagcgatttttagcgggccaagaactggttccgaaaaagcacaggtacaccgaaccctcagctaaggagggacagcaccgatgcggaaggacaaactttctttttgcctatcacagtatcttatcgagctaactattttcgacacacatgaaaaagcagaaatattaacgaaaaagaaaagaaagaccatgtcatgtacgggcaatcagaatctgtaacaagcgccatttttttttctgtatcgggccctccttactgctctccttccgtgtaacgcgttatgaaactctaatcctactatcggcgactctctcgaaatttttcttaacgcgtccttgtactgcgtctaacgcttttgccacttggatttctattataggaaatagtctcacttactgggcgacgaattttcgcgttttgatgaagcacaggaagaatttctttttttttggcttcttctggttccgttttttacgcgcacaaatctaaaaaaagaaataattataacctagtctcgaaaattttcatcgatccattcgttcctttttttcgattttttcagatcaaaattcttgtttctttctttgtcttagtttatattaaaagatattttgattttactcctgaactatttattctttctaagaaggccagaacactacagctgttttaaccgactacgaagttctccattctcgaacactagccttcatttaccaaacaggaactagcgtatatcattagtccttattcgaaaagagattggtagatatttattgtagtttgtgagaaggagaaaatactgtcattggactgatagttagaggacattaacctctcttacgttcgctcaaaaaaattaaaataagcaagtagctgaaatcaagtctttcatacaacggtcagaccatgaacactgatcaacaaccttatcagggccaaacggactatacccagggaccaggtaacgggcaaagtcaggaacaagactatgaccaatatggccagcctttgtatccttcacaagctgatggttactacgatccaaatgtcgctgctggtactgaagctgatatgtatggtcaacaaccaccaaacgagtcttacgaccaagactacacaaacggtgaatactatggtcaaccgccaaatatggctgctcaagacggtgaaaacttctcggattttagcagttacggccctcctggaacacctggatatgatagctatggtggtcagtataccgcttctcaaatgagttatggagaaccaaattcgtcgggtacctcgactccaatttacggtaattatgacccaaatgctatcgctatggctttgccaaatgaaccttatcccgcttggactgctgactctcaatctcccgtttcgatcgagcaaatcgaagatatctttattgatttgaccaacagactcgggttccaaagagactccatgagaaatatgtttgatcattttatggttctcttggactctaggtcctcgagaatgtctcctgatcaagctttactatctttacatgccgactacattggtggcgatactgctaactataaaaaatggtattttgctgctcagttagatatggatgatgaaattggttttagaaatatgagtcttggaaaactctcaaggaaggcaagaaaagctaagaagaaaaacaagaaagcaatggaagaggccaatcccgaagacactgaagaaactttaaacaaaattgaaggcgacaactccctagaggctgctgattttagatggaaggccaagatgaaccagttgtctcccctggaaagagttcgtcatatcgccttatatctgttatgttggggtgaagctaatcaagtcagattcactgctgaatgtttatgttttatctacaagtgtgctcttgactacttggattcccctctttgccaacaacgccaagaacctatgccagaaggtgatttcttgaatagagtcattacgccaatttatcatttcatcagaaatcaagtttatgaaattgttgatggtcgttttgtcaagcgtgaaagagatcataacaaaattgtcggttatgatgatttaaaccaattgttctggtatccagaaggtattgcaaagattgttcttgaagatggaacaaaattgatagaactcccattggaagaacgttatttaagattaggcgatgtcgtctgggatgatgtattcttcaaaacatataaagagacccgtacttggttacatttggtcaccaacttcaaccgtatttgggttatgcatatctccattttttggatgtactttgcatataattcaccaacattttacactcataactatcaacaattggtcgacaaccaacctttggctgcttacaagtgggcatcttgcgcattaggtggtactgtcgcaagtttgattcaaattgtcgctactttgtgtgaatggtcattcgttccaagaaaatgggctggtgctcaacatctatctcgtagattctggtttttatgcatcatctttggtattaatttgggtcctattatttttgtttttgcttacgacaaagatacagtctactccactgctgcacacgttgttgctgctgttatgttctttgttgcggttgctaccatcatattcttctccattatgccattgggggggttgtttacgtcatatatgaaaaaatctacaaggcgttatgttgcatctcaaacattcactgctgcatttgcccctctacatgggttagatagatggatgtcctatttagtttgggttactgtttttgctgccaaatattcagaatcgtactactttttagttttatctttgagagatccaattagaattttgtccaccactgcaatgaggtgtacaggtgaatactggtggggtgcggtactttgtaaagtgcaacccaagattgtcttaggtttggttatcgctaccgacttcattcttttcttcttggatacctacttatggtacattattgtgaataccattttctctgttgggaaatctttctatttaggtatttctatcttaacaccatggagaaatatcttcacaagattgccaaaaagaatatactccaagattttggctactactgatatggaaattaaatacaaaccaaaggttttgatttctcaagtatggaatgccatcattatttcaatgtacagagaacatctcttagccatcgaccatgtacaaaaattactatatcatcaagttccatctgaaatcgaaggtaaaagaactttgagagctcctaccttctttgtttctcaagatgacaataattttgagactgaatttttccctagggattcagaggctgagcgtcgtatttctttctttgctcaatctttgtctactccaattcccgaaccacttccagttgataacatgccaacgttcacagtattgactcctcactacgcggaaagaattctgctgtcattaagagaaattattcgtgaagatgaccaattttctagagttactcttttagaatatctaaaacaattacatcccgttgaatgggaatgttttgttaaggatactaagattttggctgaagaaaccgctgcctatgaaggaaatgaaaatgaagctgaaaaggaagatgctttgaaatctcaaatcgatgatttgccattttattgtattggttttaaatctgctgctccagaatatacacttcgtacgagaatttgggcttctttgaggtcgcagactctatatcgtaccatttcagggttcatgaattattcaagagctatcaaattactgtatcgtgtggaaaatcctgaaattgttcaaatgtttggtggtaatgctgaaggcttagaaagagagctagaaaagatggcaagaagaaagtttaaatttttggtctctatgcagagattggctaaattcaaaccacatgaactggaaaatgctgagtttttgttgagagcttacccagacttacaaattgcctacttggatgaagagccacctttgactgaaggtgaggagccaagaatctattccgctttgattgatggacattgtgaaattctagataatggtcgtagacgtcccaagtttagagttcaattatctggtaacccaattcttggtgacggtaaatctgataaccaaaaccatgctttgattttttacagaggtgaatacattcaattaattgatgccaaccaagataactacttggaagaatgtctgaagattagatctgtattggctgaatttgaggaattgaacgttgaacaagttaatccatatgctcccggtttaaggtatgaggagcaaacaactaatcatcctgttgctattgttggtgccagagaatacattttctctgaaaactctggtgtgctgggtgatgtggccgctggtaaagaacaaacttttggtacattatttgcgcgtactttatctcaaattggtggtaaattgcattatggtcatccggatttcattaatgctacgtttatgaccactagaggtggtgtttccaaagcacaaaagggtttgcatttaaacgaagatatttatgctggtatgaatgctatgcttcgtggtggtcgtatcaagcattgtgagtattatcaatgtggtaaaggtagagatttgggtttcggtacaattctaaatttcactactaagattggtgctggtatgggtgaacaaatgttatctcgtgaatattattatctgggtacccaattaccagtggaccgtttcctaacattctattatgcccatcctggtttccatttgaacaacttgttcattcaattatctttgcaaatgtttatgttgactttggtgaatttatcttccttggcccatgaatctattatgtgtatttacgataggaacaaaccaaaaacagatgttttggttccaattgggtgttacaacttccaacctgcggttgattgggtgagacgttatacattgtctattttcattgttttctggattgccttcgttcctattgttgttcaagaactaattgaacgtggtctatggaaagccacccaaagatttttctgccacctattatcattatcccctatgttcgaagtgtttgcgggccaaatctactcttctgcgttattaagtgatttagcaattggtggtgctcgttatatatccaccggtcgtggttttgcaacttctcgtataccattttcaattttgtattcaagatttgcaggatctgctatctacatgggtgcaagatcaatgttaatgttgctgttcggtactgtcgcacattggcaagctccactactgtggttttgggcctctctatcttcattaatttttgcgcctttcgttttcaatccacatcagtttgcttgggaagatttctttttggattacagggattatatcagatggttatcaagaggtaataatcaatatcatagaaactcgtggattggttacgtgaggatgtctagggcacgtattactgggtttaaacgtaaactggttggcgatgaatctgagaaagctgctggtgacgcaagcagggctcatagaaccaatttgatcatggctgaaatcataccctgtgcaatttatgcagctggttgttttattgccttcacgtttattaatgctcaaaccggtgtcaagactactgatgatgatagggtgaattctgttttacgtatcatcatttgtaccttggcgccaatcgccgttaacctcggtgttctattcttctgtatgggtatgtcatgctgctctggtcccttatttggtatgtgttgtaagaagacaggttctgtaatggctggaattgcccacggtgttgctgttattgtccacattgcctttttcattgtcatgtgggttttggagagcttcaactttgttagaatgttaatcggagtcgttacttgtatccaatgtcaaagactcatttttcattgcatgacagcgttaatgttgactcgtgaatttaaaaacgatcatgccaatacagccttctggactggtaagtggtatggtaaaggtatgggttacatggcttggacccagccaagtagagaattaaccgccaaggtaattgagctttcagaatttgcagctgattttgttctaggtcatgtgattttaatctgtcaactgccactcattataatcccaaaaatagataaattccactcgattatgctattctggctaaagccctctcgtcaaattcgtcccccaatttactctctgaagcaaactcgtttgcgtaagcgtatggtcaagaagtactgctctttgtactttttagtattggctatttttgcaggatgcattattggtcctgctgtagcctctgctaagatccacaaacacattggagattcattggatggcgttgttcacaatctattccaaccaataaatacaaccaataatgacactggttcccaaatgtcaacttatcaaagtcactactatactcatacgccatcattaaagacctggtcaactataaaataatacaatcaatacttgcttgaacgcttgattttactgatattctatccaaaagcaagtagaccagaaactctcaagatgttgcaaataccgttcgatgtttttggtttagattgttttaatgttgatgcttttttacttatttttggaagcgtctttttaatttagttttatattataggtatatgaatgtgtttatgccaataagggtttttttgtacagttatgtgattataaacagtcttttgtctagtttttttcaccagtatcggcctctatttataaaaaacggagcagctttcggtgtcagtaattctgaaaaaatttgtgtcactctgattgtaaatgaattaatttagctagatagttgcgagccccaacgagaagattgtcagacaaagacaacattcaacaacctacatccgttactattcgttaactcgaggtacttgaaacttttcagttaagtatgaacaagaaacaaaatttttacgcagccattattgtggctatttttctttgtttgcaattgtctcatggctcttcaggtgtcagctttgaaaaaacccctgctattaaaattgtaggaaacaaattctttgactctgagagtggggaacagttcttcatcaagggcattgcttaccaattgcagagaagtgaagaggagcttagcaatgcaaatggggcttttgagacaagttatattgatgccttagcggacccaaaaatatgcttaagagatattccatttttgaaaatgctaggagtgaacacactgcgtgtttatgcaatagatccgacaaaatcacatgatatatgtatggaagctctatctgccgaaggaatgtacgtcctattagatctttcagagcctgatatttcaataaatagagaaaatccatcttgggatgtacatatttttgaaaggtacaaatctgtaattgatgcaatgtcatcctttccaaatttgttggggtattttgcagggaatgaagtgacaaatgaccatacaaatacctttgcatcacccttcgtgaaggccgcaatccgagatgccaaggagtatatttcgcattctaatcatagaaaaatccctgtcggctattcaactaatgacgatgctatgacaagagacaatttagcaaggtacttcgtttgcggagacgttaaagctgatttctatgggataaatatgtacgaatggtgtgggtattccacgtatggtactagtggatatagggaaagaacgaaagaatttgaaggttatccaattcccgtgtttttttcggaattcggctgcaatcttgtaagaccaaggccattcactgaagttagtgccctttatggcaataaaatgtcctctgtttggtctggtggccttgcatacatgtattttgaagaagaaaatgaatacggagttgttaagataaatgataatgatggagtggatattcttcctgatttcaagaatttgaagaaagaatttgcaaaggcagatcctaaaggcattacagaggaagaatacttaacggcaaaagaaccaactgaagtagaaagtgttgaatgtccacatattgctgtcggagtttgggaggcaaacgaaaaactacctgaaacacctgatagaagcaagtgcgcctgtttggatgagattttgccctgtgaaatagtcccttttggtgctgaatctggaaaatatgaagaatattttagttatttgtgctctaaggttgactgttccgatattcttgcaaatggcaaaaccggtgagtacggtgaattctcagattgttctgtcgaacaaaaactttcccttcagctgagtaaattgtattgcaaaatcggcgcaaatgatcgccattgtcctctaaatgataagaacgtttacttcaacttagaaagcctgcagccccttacaagcgagtcgatctgtaagaatgtttttgattctataaggaacatcacatacaatcatggcgattattcaaaatcaaatccatcgcgtagcaaggaaagtttgaacgtaaagtacccatcgagtgaagagagagaaaatgacggcaccatcgcatttaaaacttcagggtttgttatacttctaatttctatgatagctgctggaattcttctataaaaaattcatttaatattcaatgaagttataaattgatagtttaaataaagtcagtctttttcctcatgtttagaattgtattaatgtacgccgtttacgttggagtgtaaatgtgtctattccagaacgaaatctaaatgagcagtacaggcagttcagatggtactgaagcggtactaaagatgcatgaattgaacagatgtggtagttatgtatatgaggaatatgagttgtcacattaaaaatataatagctatgatcccattattatattcgtgacagttcgtaacgttttaattggcttatgtttttgagaaatgggtgaattttaagataattgttgggattccattattgataaaggctataatattaggtatacagaatatactggaagttctcctcgaggatataggaatcctcaaaatggaatctatatttctatttactaatatcacgattattcttcattccgttttatatgtttcattatcctattacattatcaatccttgcatttcagcttcctctaacttcgatgacagcttctcataactcatgtcatcatctaacaccgtatatgataatatattgatagcataaccattagttgataggtgatggtggaattttatttcaacagttttatacctctcttatataagcacaggaaggtccatatccacatttaaacttgattaatacttttttttatacctttaactatcatcatcaataatttcttttctgaaagtacgacatcaaagtcgccgagttttgtcttcggaataaatactaggtcagatgaataaagagcaggaatttactatctctgataatttattatgctcctctagtgcaatggttagcatgcattcttccggtggctgtgatccgggttcgagtcccgggaggagcttttaattttttagcgcactattctaatttttaaggaaaaagcatatttccgagtcagtgcatagaaagaacggaggctacgatgccagcacagtgtctataaagtcaagaaatacattcaaactcttcgcgtaagggctgtcaatttttcatttccctcaaagttaatgcgcaagagttaggatgatcttgattattagttatttgtttgttccatcaattatgccgacgtccatgaatgctattgaagtatcgattacttatgctattctattgtatttgagccggcggctagtaaacaagacagcatacctttccaacatccgtacatattgattattgtatctatgattttcatgtaatgtatgggttaactaatcctttctcttctttttttttttctgaaaatcagtagctagaggaacctgttcgtgaaagatatggaatattccgtctagggaagagccgagagctgagagcagtatccatcggatggaatcttgcctggatgcgtaacgacgacagcttgtctagaaggcgaagtacaagatactaagaagactataacaacagaagacaattttgtagtgcgattctatattattgacgtaaccaacaaaaaagtatcagaatggctaaacaatcattaggtatgtgcacaaatgctaaatcactgaaaccctgtagagctggaattgaaaatatagtttgtaccttttgcctgagggcagaatgactcaatgttatcttaattcgattagaaaaagaaggtgcgttatccaaggttgaaacttgtaaactatttaggtgatgtctcataactgcaaccactggaaaatgacgcaaatatcaaaataatagggagataaagtctcacgacatgaaaaaatcatagaattattgttcaatttatctagccgtatcttaccttatggaaaaagtgtgaatatgtttttctaaatcgagcttcccggaaattacactatattatgcatccgtgatacatctgaaattcaatactttctccaaggtcctgcttactaagagggtaagatttgttgaaactcgaaatactaacattattttcattattttagacgtttcctccgacagaagaaaggctagaaaggcttatttcaccgccccatcctcccaacgtcgtgttttgctatctgctccattatctaaggagttgagagctcaatacggtatcaaggccttgccaatcagaagagatgatgaagttttggttgttcgtggttccaagaagggtcaagaaggtaagatttcatctgtttacagattgaaatttgccgttcaagttgacaaggttaccaaggaaaaggtcaacggtgcttccgttccaattaacttgcacccatccaagcttgtcattactaaattacatttggacaaggacagaaaagctttgatccaaagaaagggcggtaagttggaataaattatgtaattccctgaaaacttcctcgaaatttattgcactttttttactcaaaccatttaataatcatatgtaaaacgtataaaatagtatccattccactgtactcagtgtcttacgtaaagggctgtatactggcactaccttttactatggatatgtgctagctttttcggagaagaaatgttcgccttacgctagaaaccggggttaagggggcgtgagaatgaatattggcagacaagaaccgagatagaatcttaacacaaaaacagttcatcctacttctacgcctttatacagttatactgaaagatctttgcataggggcatagtttaaaataaaatatagggttgtcatagcaaacatgccaaatgtgctttctgatgatgaagagctccttaatggactaggaagtgagattatgaaaccctctagacaaggtaaccatatggcaaggaccgtcaaaaggtgggtaaataaagaacgtgctaccacagccgatctgaaaaatgttaatattgatggagttcatggaccggtaaataccgaaagttatatatcaccaggacagctttactccactgactcgggcaatttatttcatgctggaagaatccttgtcgttctagtcggtcttccagcaacatcaaagacactattgtcagtagcgattacaagatatacaagatggttaggagttaggacgaaatcgttccatttttcagaatataaagaatcagctaaaaatataccctcagactatttttgcgtagtgccaacgtcaaaagaaggtgtagcgtttgttgaaaagcttcgcatgcagatgttgaatgatatactggcatttttcaacgacttgtcaggtcagctggccatttatgatgccctaaacatccgtaaaattgacagaaagaatttggagacaacgttttctgaaattggagttaaagtactcttcatagaatcaatcgtgtctgatcaagaaatcatgaatagaaacatagctcttgcactggagtcgaacgattacaagggactttcaactgatgaagccattgacgaatatatgagacgtttatcagtgaacgaaccatactatgaaatgatgacacatgacgaagaattatcgtacattaaatatataaatttgggaaagcagataattgtgaaagataacatacatggttatttggtcaacaaaatagtatttttcttaatgaatttgaggcagaaaaaggggtgtgtatattttgctcgctgtggcaccagcgataaagacaactacatacatgatgaggaactaaacgaggagggaatccattactctcaagttctcaaggattttgtcctccaacgaattaaacagaagagacaggccaaaaaaaattcggattccttagtcgaagtaatagatggaagtcatgatgaagatttgaagacttccttgatagtttggacaggtcccaggaaaagaacccacgatactgcactctttttttcaaaagaaggtattaaagttcagcaacggtcagagttgagacagttgaacccaggaagtattgctgatcttactgatcaacagataatggacaaatttccatcagaatataaagaatcattaaaagacccatatcattttcgattccctagggcggaatcttaccatgacttagccgttcgtatggaacctttactattagaaatggagcatacgagcaaggacattctcatcattgcacatgagtcaacattaagagtattatatggctatttaatggcttgcacctgcgtagagttaccaaatctaaatttcacaagagacaaattagttgaaatttcattcagccctttctgtaatactgtagagttactgaacattcctttaactagctaatatactggagttgcatcgttgatgtgtattatctatattcaaaatagttatttttatgtttaagaaaggattaagaacaattgaaaaaaaattaccattagcaacgaatattaaattgtaaattatttagagatatttttctataatatgctcgcctaccattctcttttatacaatatttaggttttacctggaggctaaaatgatatgaggggacgatagcttaacatgattgtgacacaaactttaaaaaaggctttcagttgaagagttttcttccgctatagtctccaatgctatcttacttttcttattacgtttatgtctacctttcatatcatttcttgtaagcaactcctgcatttccgcttcctgggcagccttgagtaaatcatatctggtaattttatcaggtttattgctcacatatctgcctgaaccaacaacgttgatatatttccatggacatgctacccactctgcaatagtggaagctgaattgattgtgttttttgaaactaacccgatgggacaattactgatcgattgcattattaaaggtgataaataatcctttgttatttgtgccccttaaaattcatatacactttatgtttaattcgacaggtataacagaaagaaacaaggaaaacaatgcaattaatcattaactgcaccaacttttatatgaatatattgtgctacatgtcttaattagtcctctgtgaatgagcatcacaaagaatcacgaggaaaagattgattacttaatattgataggaatcagccgcggaaatggaaatcttggtaatataattttaatgcggcacgctgaaaattgatggcggcctgctaggagccctattgattccgcggaaataggcggattattacaaacgttgagcattcagcaggtgcggctgtgccttttcactttcagctaagatgtttgcaagcaagaattaacagataagccgcttcgctagtaacgcaactcattgtgtttttaatggaagctaaggatggttgaaattatgggtaccctgagataagattattaactatgatgtaagtattaatcattataataaggggtacctgctcattcgcattaccatacattgactattaacgagcagaaagtttttggaagttttgcagatgaagtgcatgtttgataatttgaatatgcggatttccttattcaaaactttctttatgcatagagctaattaggtttgagttaaggaaaaaaatctatcataagtgtcttgaggtatttactataatgtatacgggaaatattaggtgtgataggctctaggaacgaatattaatattgggggggggaaactggaatgaaattaaacaaaagcaaaaaaatctaaaagaagaaaaaaggagagagagagagagagagagagagagagagagagagagagagagagagagagagagagagagagagagtttggcaagagtnnnnnnnnnnnnnnnnnnnnnnnnnnnnnnnnnnnnnnnnnnnnnnnnnnnnnnnnnnnnnnnnnnnnnnnnngagagagagagatgagggttattgataatataatataataataaaagagaagatagtagaaaaggaagaaagaaaaaaaaaaattaagatgtactttaataaaaagagggaaattctaaaaagtgcgactggaattagaagaatgcaggtattttgttttctctcctatgacggagaaggtaacaaaatcataaaggtaaaataacaaattaattatgatcaaagagaaatgccctttgtaaaccgtggtttgtaaatgcgttggtaactgcagcagatgttaagaaacaaagatggaaaagaaccaaaatcagcttgtaagttctatcgtaattataaggataattgacgcttctgttgctctctagcccatcttgctgtatcttttgtggcttgactgaacaattggccactcctagttcttttaatgtaatcaataacccagtcttgtccataaaattgtttgattgagccgtctggaaacatcgctgctatatcaccaatcaatccgactgctgctcttgaggtagcatcctcactgtacagctgaggatcttctgcaacttgtgcaatgaactggaatatagtaccaacataagggaacagagcttcaggtttatcatgaagacccgctactatacccacataagcatctagtactgcttctagtacttttatttgataatcaagggcttctaatgtgccgttttccggcttcgtgttttgggcagcaacacacaacgccatgatgtcattcaagtagggaataaaatcagcacctatattggaagcaatatcaccgaacacgctcaagacggctggtttcaactctctccttgcatttggattagagatcatttgagccaagacattcatcatagcatcggaatatcttctgaaatcttcttctaacgaatttgaaatatcagcgatgaagcccactgcggtgattgaaactggcgaatctacttgatttaaagcctttaataaatagggagaaaatgtttccaggtatttctcaaatcctttacccaaagaagcagctagagctgaaatagcataaaacacatcgtcttcaataaacgcagagtcctttttttccaacaacctgaagaacagtcccataagcatatctgcaaccggttctacactacttggactttttctaataacggctgctagaacagtcaatatatttgactgcaattcttgcaaactttgcgcatcttctaacgttaattgattttcatcaacactcattgtctgccctaatttgtccataacaaacgtagaaatggaggcggaagtttcagctaccgtgtccgtggcgtattcaaccattgttgtcaaggctgaaaaggcggatgcacgggcattgaactcattatcaattctatttgcagcaccgatcaaaccatctacaagagcgggatagaagttatagattggagatggtgtggcttctgctaattgttcgactaagttgataatggtccaagaacagtttgtggccacttttgggtgatcttgcaacccaattaaacaagcttgaacgacacctggaagatgctgttgtgggtcgatagattcagcaacagaatcagcaattctaccaatacaccaagcagtggtttccttaacttgtagggattgatcgttcattaaattcaaaatagatggtaaggcttggtgaacgtaataggttctttggaccttatcagggccatccataatggaaccaaaggccattacagcagcttcacgattcctccagttgtcagcggtaatattttgttcaacaaattccaatacaggttctaagatatgattgccacagttttgggcaaacaactgcaagcatgcacctgcggacatggaaacattccaatcgtcatcttctggatcttcattttgtctcgttagaaggttcaacaaattggggacaacatctttaatagaagagagagcgaaattataactctgtaaaggagattgaggaaattgagcgagctcataggcaatatcgatttcttcttcacaaatagtggaccagaattccacagtcatggaagctactttatcatttggagatttcattgtagctatggtcaatgcatatagggcttgctccatgtaaggtttcataaatgtatagtatagtgacatgattttacacaaacaaccaaaggcagctgcttgaacttctatatcttcagcttgagtggcttcacagacgacttgcataaggtagtttctttcaccttcgcgttccatgttatttttgatgaaaattaaagagtctgcaagagcattcagagctgccagtctgactgctttggaagtttccgtagattgcgcaccctggacaatagcgattaagatattgtttgatgaagaaactaaggcttgactttgagggtctgcactttcacacatataacccaaggccaataaagaggctctcttgacattttctggttgttccgcacctgtattgtcaaccataattttcatcaactctggccatgcgccatggggcaactcaatatctgctatagccgcaatcaattgagctgctgcatttgctatacgcggttctatggagaccaatgcggtcagcgcgttagttttaatttggtttttagcttctggactaacctgtgtaatccaacgttgtgcaaattgctgcgtcttgactgagtccttggacaccagctcgttcttcaaagttagcgccgctagaatacgcccttctagctttgtattttcatcgataagcacttgcgaagaaagacctgcaaattgtaagaagttgtcattagataatttctttaattgcgtttcactagtcaaccgaatgttttggtcgggacttaagatactgttctccaatagttgagcaaattcagcggtggacattgctccttgtgtgatatgatggattactgttaaatcagttttattctacccctaaaaaccttgcaaatataaagagaaaaaggacagataattctccagtaatattatcctttacttcttaatgatatctgttctttaagcgaaaaatacaagaaaagaaactggagagtttacgtatatttgcctctcttcgcagttatttttcttttttttttatttttttttccttggttctctcatccaagtttttccttattgcccttccagcaaaattcgaaaattttctttctcgccaaagaattctatactcgtttaacatgatacatttatcggaacatcggtaggaagtggcctgcgactgactatccatttgatcgctgcatgaggaatgctggttatctatgtatcgggacatggttgcaacgtttccaacaagaacaagaatagaaaaaaaaataccgaaagcgtcctttgcgttatacctaccaaccgtgtacaagctttactcttcttgctttctttatttgctatgtatctttatgtttatatgtatataaatctgcctacttgtcttcctttggcatgccaaccctatgttttttcaattgctcaattgcaaagaaaattaacattgtgaatggacccagtctagtgaaacttggcaaccacccccggaacatgaaagatgggccctctttgcggacagcgtcggcaaggatcttcaaagccggttgatggtctccgctgccgttcatgatacgtgtcttcatgacgtctgctggagagcacacagtggtggccaccaggccagccaacagggacgctgtcaagtgtgtatagttcttggatgcgtcgaaatctaattttgtgaccaagtagttcttaaacacgtcatacgtaacgacctgacttgccgtcatcagtatgcccctaaccatgttaggcttccaaccggtaaacaaggttttcagtccaccctcgtagcgatatatcttgtacacaccatcgatagcgtttttgtagtttctcctcttcgctgcctccaaagcagagtcgttttgcattctgatatttacaacatctgcaaaattccctgcaagccccccaatggcaccactgaacatggagcaaggtaaaagatacgccatgttagtcaattgctcgcgtgggatcacattctctttcaacaagtcgtatgcaccgaatctcaccgtcgtgtatgtacattgcctcaacacagcagcgctcaggccggaatataaccccaccacaccttcattcgccaagatactctccaacatcctgaagagtgtgggcttgggcataggagccgcctgcagtctgactttggccaagtcaagaggatgtgtcaccatggtagcaaagatacccgctgcacctccgtaccaccatggatacttgatattcttaccggcagactcttttgcgttggttgacatgccgtccagctgttgcgttatcttttcgacactttcagagcaagagaaacgaacctctacacataaatatgcatacgattatgtatatccatatatatatatacactacaagccgaccgcccgaccgtttcctgcccccaacattgcagcgtaatcgcttgccaaagaccacaccttgcagcccttttatacaaacatgtctacgacgtacagtggagagggccctttccttggcactcaactgagattgcgacgcgataccttctgcgaccgttcctactatcgcggccataactccaacaacgacagcggatgcgctgttctgcggatgcgtgaccgtatccgcaaagaacgaagattaaatttagggtccccggcattgaggatggttctgccaagaactcacgatataaaccagttggttgagcatcgcatggatgagtatggcgtattttgattgctcatatatagtgggggggaatactcatgctgtgaaaagcacaactcttttcactcaacgaggttaatgccttctttgtctccacgccgtttttttctggcgcccttttgagaaagatagcctgtcccgtaatcgtggctttggcagagacagagggtgagcgaaagagcgggcgaaaccgagaatggattccgagtaaaggattgcgatggcatgaaacaaaaccgagaggcactccttgtaaggacacacatacacagacgtaaacatatatatacatacgtatacgcaaatatatcttcgtatcattaggtcagcttctctcttccgcacgtagaattagagaattaacgcaagactataccattataaaaacgcataagaaacagtttcatcatgattgaccgcactaaaaacgaatctccagcttttgaagagtctccgcttacccccaatgtgtctaacctgaaaccattcccttctcaaagcaacaaaatatccactccagtggccgaccataggagaagacggtcatccagcgtaatatcacatgtggaacaggaaacctttgaagacgaaaatgaccagcagatgcttcccaacatgaacgctacgtgggtcgaccagcgaggcgcgtggttgattcatatcgtcgtaatagtactcttgaggctcttctactccttgttcgggtcgacgcccaaatggacgtggactttaacaaacatgacctacatcatcggattctatatcatgttccaccttgtcaaaggtacgcccttcgactttaacggtggtgcgtacgacaacctgaccatgtgggagcagattaacgatgagactttgtacacacccactagaaaatttctgctcattgtacccattgtgttgttcctgattagcaaccagtactaccgcaacgacatgacattattcctctccaacctcgccgtgacggtgcttattggtgtcgttcctaagctgggaattacgcatagactaagaatatccatccctggtattacgggccgtgctcaaattagttagttggctctgcctatacgcatatatatatatatatgtatatgtatatgtatatgtatatgtacgtataccttacatcatcatctttctttatattctctctaatgcgcatttacatcggagtacacgtcaaatcttctttgttttgttaagggtaccgcttgtctaaatgactcaatgacttcgggatctaattcagcataaataatctcttctccctcgccagcttcagctacaatcttgcctctggggtccaccactatagagtggccatatgcatggtaagaactctgtagattccttgcgggagaacataacatcacgtacacttggttgtcaactgccctgcttcttgccagtaaatgccaatgcaagggccctgtgacagtgttgaatgcactagggtagatcatggcaaacgcacccttgcgtgcacttagcattgcgagttccggaaacctcatgtcatagcatatacctacgccaaacttaccatatttcgtgtcaatggtagtagacttctctccagggctcaaggtttcactttcatggaacgatataccgttaggaatgtctacatcgaaaagatggaccttccgatgcttgtcaatcaacttgccatcctcgttgaaaattatagaggtgttgtagattttgtctgtctttggatccaattccggaattgttcctcctaccaagatgattttaaacttattggctaaattagacagaaattgaactgacgtcgaaggctctttcggattgataacttctgaatactttctaaactgatcagtggagtacggagaattgaagcattctggcaatacgaccaacttggtatccggctgttccttcatagccctttcaatgaacgttgcagccctttgaagattggccattttgtcaggactcgagcctgacagttggaccaacgcaactttaattttttgtgaaagaatcttcgaagcactcatactggcgatcttcacgccctcctgctattacaaaagctgtgtttttacaagaatcaaattaagttagcaagatatcatacaacattattgataatttcaatatcgtgttcgtacctgatgacgtatctgtgcattgataaggcccgcatggtttcagaaagcagagcggaacgattccaaattagtggccttgtgctttgcatgtcaattgtgttaccttcagctcgtggatttgttttatcaatacacagtctacagtcaagaattttttttatcaaattttgcgttcgagcgtataaaatagccgctgtagctacttaagttcctgttcagcgatagtttttttccatcacacatactatggcgccaactttgaactattccttccccgtttactcaattcttgaagccaatttgtacaattccccattagagtcaaataaaaggatgcctcacggaggtatgttacccgcgctatttcacatggctcattgaattagaggtggaatttggtgtaccctcccctcctcatctgatgaagtagtgatccgacaattcttaaaagttgtagacattacttttaccaccaactaagttgtatttatattgctacccttatccttttatatctaactagcgctcataaggttggggcaatactaaaactgtgttcttattcaactcattaaatacgtggcagtacgtaccctattagaaacaataggaaacagcagagtcggaagaagccaaatgccagatttgaagtccaaaaccttgtcaagccaatctttgggagcggctattcctccagaaattgtgtaccaaatacttacataccagtttagggatttgttaagaaatgaccatccaggtacagcagaaaagtttaacgaaaacttaactacatttgtcaaaagtaatttaactgttaataagacattctcccatatttgtcaagttctcatttatagatattgtaatttaactaccgcaaagagatttcacggtcttttacagactttaaagggaaatagatgcctttgcaataagattgaagtagccgatttccaagaattaacgtctattggactggggaggtccagtgagatgaataaaatgattaaaaatctaactaacgaaactcttcttgagtttctaatgctcacaaaagcaaacttaagggaattcttagcatgtgaaaatattcaagacgatttagacgataatatcataaagtatattctatctccagaaaaagtcttgagtgtagtggatttctgtggctgttcaggtaccactttcacagaaagttttattaaggccctggataaatactaccctaataaatcgattgatcagtaccggctggaacctattcaacaaaattatcagattacctgcttaggcctaaatgattgtattgatctaccatcacacgttctttggaagatcttaaaaatgttaccagaactacaaaaacttgatttatctcatacctccattgatgatagtaccttatatcacggcatacctcactggaaaaatttaactcatctttccctcgctacttgtcttcaagttactccaagagcggttctggagttttttagtcatcacccaacaattacagaccctgacaacacttctacattagaatggctgaatgttagtgtcattgcccattcctcatcttggaatgaggtgcacacaatgtttttactaaaaaaactttgtcaacatggccataacaaaactttgcaatatctaaatatcggcggtttaccgcttcatgttgcaccttctttcagcgaggaccctattagcgaatccacctattattaccaatgccgcgatagcttacagttcattaagtggaattttcctaagttgaaaagtttaagtataaaaggtaatagcatcccgatatctacgctcgtagaatttttaacaccaattgatcaagaccatcctaattgtgctcaaaaattgaagtttttgaatatttctggtaactcttatgttaataaatggactattcaggacttattattgtacacttgttctccaagtttagtcgcgttagaagtttcctttgactcgtggcaacagattgaaaaactaaatgatagacatgaaattattgcatacagatataaaaacccaaattcggtaattaaagatatttcaacagcagaacaagtaaagtggaaatgttacattgattcttcgtatggtaggagatattggttatataagactgatccttttctgaatcgtgatgacttggattctaagtcaaatttaactaggtatgattttgagggtcacaaaatcatagaaattataaaccagccggatttcctaaagtttgcccaaagtaaaatcatgcttggatgtggtctagttcctcaaagtggtattagacgtaaactatgttacagagatttaaagccaccagtttctcaattcttaaatagaaaaggtgcgatcagccttggtgatactccactaccaataattaccccaacattacctcgtggtgggtggagaatcatccataatgaggacgacaacaacagtcatgtggaagatagccaaaatcacgtgaatgccatcccaagaaggaattctctgttgagcagacccactttaagaagcaacaatggttcttcctctgccaacccctttgctatcaatgtttctcctgcatctcaaatcagggatggtttgtactgggataggtcggtccatgatttacgtgagctatcattgcaagaacaaagaattcaggagttagctgatgagcagcaggaactaagaacaatcgcaaactttgaagagactgacgacgaatatttgcacgatcccgacttgcaacggagaaggtcccaacttcacttatttgaaagttcgcgctcacgttcaggaaataaaacaagaccaagtttaactggtgaacactcgtcctcggcatcgtttctatccttctcccacttcaaccaccttcacaagcgtaagaattattatttcacgcatcccgatgaatttgtctatgatccaaaggatcctctgacgactcaaagatatagattacattttgaaatagtcaatgaatatcaagtttttgggtgcatcgagcgtggaatgtatagatactacagtttaaaagcatagttatttttctctttacttccttacccttcctccgctctcgtcttgtgtcttgtatatgatttctatatatggtaaaatattgcatacatcgtctaccatttagccagacttttcggaaacgaatttagtgattgcagcaaattcccttcccctatcaactgattgaagaatgcctcgaaacgcaatgtgatttttaagttttccatttttttttttttcataagggaagcctctctcctccgaaaaaggtaaacattgcgaaaaatgatccaaaagagagaataaaaaaacaattagaaaatgatttactcatccgcttactagagaggccaaaccggatagtcctgacgctaataagagtaggattaagttcattgtggtgtgtttttttattgcgcgtaagcgatacctgcaaaattcattataattttcaatcaccttccatcaattatcaataccccatactaagaacaggcaattggtttaggaaggaaaataataaagatatccaaagacaactggaagctttccagtcgcgacctctgttttgttcgaacttctagttaacgaaagaaagaccattcaattgcttttttaatattcattattgacgatttttatttctaggcgattaccggtatacttttcattcttttgataagataataaatccaattacattcgcttattttaattcaatttagactataactttctcttaactctaggagtttctttcttgaatcgaagcatttttgacaatacccaatatcctctttctacttgagaattttttcgattctacatgaagtatgatacaatcagacgaagataatttggactcttctgaaacgacagcatcaacttcatatagtggtacttcctctgtatcatccagactacaactaagaacatccttgttttttgaaaatcttaatggagcacatgggaaccccgatgcggagacagagatggctactgttgcctatgaaaccacaagtagaggtcaaggatttgctgtatacatcaacaatgaaaggttttctcaaataatgggagcatccacaagctctagctctagtagcaactcgtcctctattacacaatttcacgatacccaagataataatataccaagcaacactactgtaaggccaacttcacttcgacgagacaacgaggataccgtaccgttaaggaacgtaactccttcacaaaacgcggcggtatggccagaaagagcaatgaattcaccatcttcgcagagattaagttgcgcactgacaatatcaacttcagttcttatgggagaagatgttgaaggaagccctatagagcaagagcatagtagggtcgtatcttcattatactcatctttggcgaatcgcgggaacgacgagtcaaagaatggaacacctccacgtcctacctcaattgaacctaatgaaacaacggaacactcatttttctcatgccattacgatgacaccttagaaccagatgttgaagaggcagtgaggctaacgaagaataaaacttctaatgttaattttataagctcaactggcagtaaaggtgaaggcgagaccgaggatgaagtcatagatcaatacgaacctgtgaatgaatcaaaatttataccgcacaaactaaaaatcccagagaaggctggatcaataaagtcgtcgacaagtgatgattcgcattcgccaggtgcgccaggtacgtcggcaaggaagattaaaattcctcagagtccatcgttaattggtaacatattgattccttcacacaatagtgacagtagtaacgaaagttctcctaaagaccatatagggcataataatgaagaaaaattcaattcaaaatctatgcgcaagccctccacatccctagaagaagaaggtccaccaattggactaccttcaattcccgtattaagaagtgtgtccggacctagcaaatggacaaagacacctttacgcttagaatctggaaattcaactaagtctgatccattttcacgctatgaaggacacaagacgccctctccattgaccaagatgaacaagaaaaataaaacgttgccagaacatggacaacccctcgtgctagctccaattaaatctcaaagctcggagtcagacacaggacagaactccattatagaaaagccagctcgaagcatacgacgaaagcaacaagaaaaaactgataataggaaagaagacaggcacgatgctgaaaacatagacctggaggcgagaatgccaattcaacatatcgataccgcttccattcattcgtttgattcaggtcaaaatggattcagggacgtttacagcatcgaaaacatcattgtgatcctcctatgttgtagtatagtgccgccattattttttattattggctgcagctcaagaaggaaattagtttcagactatagattaatgaggttgcttatgaataaagaacaccgagcggctttgctgcaaggattcatatgggacgttgatttaaggtggttccggatgttttgtctgatcttaggggctgccgaaacagtgattgtgatggccggtattgctattggatttggtgtgggtataacacttgaataagaaactgtatcattcatcaaataggataaaaaataaaaaactgttctgtctcgttaaagtcatatatataaataggggattttcattaatttatatatatagatatacttgtgtacatgtacccgtaagtatcaaaagaaacgtgcataaggacatggcctaaattaatatttccgagatacttccttaagcggtaactttcttttcaatcaagtcgaatagagtaacaatatcggcagagaattttctgataccttcggacaatttttcagtggccatagcgtcttcattcaagtcgaatctgaatttagattcgtcgctgatgtaagaaatcttgtcgccggcttccttcttagcggagacagggtccaaaactcttgggaaaggttcagtactgttcatcaacttgtccaataaagctggagaaattgttagatagtcaacaccagccaagtttttgatttcgtcagtgcttctgaaagaagcacccataacaatagtcttgtaaccgtacttcttgtagtaattgtagattttcttgacggaaataacacctgggtcggcttcacccttgtaatctttaccagtgctggatttgtaccagtctagaattctaccaacaaatggggaaatcaaagtaacttgggcctcggcacaggcaactgcttgaacgaaggagaataatagagtcaaattacagtggataccgtccttttcttccaattctttggcagcttgaataccttcccaagtggaagcaattttaataaggactctttccttggagacaccttcttgttcaaacaatttaatgatatgtctagccttttcaatggtagcttgagtgtcaaaagacaatctagcatcaacttcggtggagactctgcctggaacaatctttaagatctccttaccgaattcgaccaacaatctgtccacagcattttcgacttgttcttcggtggtcttaccatgcttcttaccgtattccacggcaacatcgatcaacttggcgtaagttggttgcttggcagcagccaagatcaatgatgggttagttgtggagtcttgaggttgaaacttggcaatagagccgaaatcaccagtgtcggcaacaacgacagtgccggaggctttcaattgttctagagagttgttagcaaccttttgtttcttttgagctggttcagacattatgtacacgtatatgtgacgagttcgagaagtattttactatcgtactaaattttacctgaaaaattatatactcgagaaagaggaagccaagaattgagaaaaaagaaaaacccgcgagtaaggaaattaaatacagatgtacacatacacgcacacatatatatatatatatatgtatatatgtatataggaagcgcgcgcatgttagtatatacgattcgttggaaaggggtcgtccaccaaacgtgacttgacgagttgacaaattgacctcaatatggctcagtcagtaatttttagttccgctttattcccgccatctttcaggccacgagggtagctcataacgccgcgctaatgccgctgcgtcacagcaaccagtagctcagccaaaaccgaaagagaaatcgtagctgtcccgatgaggacttatacacttgtcaccatctaaataaattatttattcgcgtttcggttcttgttttcgatttaattagattgttcattgaatcataataaatatgtaaaaaatatatatatttgaagctgcttcagaaaaacagggcttcctagtgtacagatgtatgtcggatgaaaaaataaaaaatcttaaatgtgaaattgggtcaattcaattgactatgacttgatgttgcaaaaattccaagagaaaaagtttccagcacttgatattattttcctctttattggttttctggtctcaactttctgacttccttaccaaccttccagatttccatgtttctgatggtgtctaattccttttctagcttttctctgtagtcaggttgagagttgaattccaaagatctcttggtttcggtaccgttcttggtagattcgtacaagtcttggaaaacaggcttcaaagcattcttgaagattgggtaccagtccaaagcacctcttctggcggtggtggaacaagcatcgtacatgtaatccataccgtacttaccgatcaatgggtatagagattgggtagcttcttcgacggtttcgttgaaagcttcagatggggagtgaccgttttctctcaagacgtcgtattgagccaagaacataccgtggataccacccattaaacaacctctttcaccgtacaagtcagagttgacttctctttcgaaagtggtttggtaaacgtaaccggaaccaatggcaacggccaaagcttgggccttttcgtgagccttaccggtgacatcgttccagacggcgtaagaagagttaataccacgaccttccttgaacaaagatctgacagttctaccggaaccctttggagcaaccaagataacatctaagtcctttggtggttcaacgtgagtcaagtccttgaagactggggagaaaccgtgggagaagtacaaagtcttacccttggtcaacaatggcttgatagcaggccaggtttctgattgagcggcatcggacaacaagttcataacgtaactacctctcttgatagcatcttcaacagtgaacaagttcttgcctggaacccaaccgtcttcgatggcagccttccaagaagcaccatctttacggacaccaatgataacgttcaaaccgttgtctctcaagttcaaaccttgaccgtaaccttgggaaccgtaaccgatcaaagcaaaagtgtcgttcttgaagtagtccaacaacttttctcttggccagtcagctctttcgtagacggtttcaacagtaccaccgaagttgatttgcttcaaaccacgggtagtgatcattggcttaacgaaacgggcagctggtctgctgtaagcagcagcacgggtggccaaagcaaaggttctcttagcagtgatgacacgggagttgcagatcaatctggcggcttgagttctcaacatgttttattttttacttatattgctggtagggtaaaaaaatataactcctaggaataggttgtctatatgtttttgtcttgcttctataattgtaacaaacaaggaaagggaaaatactgggtgtaaaagccattgagtcaagttaggtcatcccttttatacaaaatttttcaattttttttccaagattcttgtacgattaattattttttttttgcgtcctacagcgtgatgaaaatttcgcctgctgcaagatgagcgggaacgggcgaaatgtgcacgcgcacaacttacgaaacgcggatgagtcactgacagccaccgcagaggttctgactcctactgagctctattggaggtggcagaaccggtaccggaggagaccgctataaccggtttgaatttattgtcacagtgtcacatcagcggcaactcagaagtttgacagcaagcaagttcatcattcgaactagccttattgttttagttcagtgacagcgaactgccgtactcgatgctttatttctcacggtagagcggaagaacagataggggcagcgtgagaagagttagaaagtaaatttttatcacgtctgaagtattcttattcataggaaattttgcaaggttttttagctcaataacgggctaagttatataaggtgttcacgcgattttcttgttatgtatacctcttctctgaggaatggtactactgtcctgatgtaggctccttaaattggtgggcaagaataacttatcgatattttgtatattggtcttggagttcaccacgtaatgcctgtttaagaccatcagttaactctagtattatttggtcttggctactggccgtttgctattattcaagtcttttgtgccttcccgtcgggtaagggagttatttagggatacagaatctaacgaaaactaaatctcaatgattaactctatttaatccttttttgaaaggcaaaagaggtcccttgttcacttacaacgttcttagccaaattcgcttatcacttactacttcacgatatacagaagtaaaaacatataaaaagatgtctgtttgtttagccatcacaaaaggtatcgcagtttcttctataggcctctactctggtcttttggcttccgcttcattgattacatctactactccactagaggttttaacaggatcccttactcccactttaaccactttgaaaaatgcggccaccgccttgggagcgtttgcgtcaactttcttttgtgtgagctttttcggcgctcctccctcattgagacacccctacttactctatggtatgcttgcagctccattatcttcatttgttctaggatgtgcctccaactatcagtctagaaagtacagtaaagtctctaaggaatcttctttatttcccgaagacagcaaacccgctgcttccgaactgagcgattctattattgatttaggtgaagacaaccatgcttcagaaaatacacctcgagacgggaagcctgcagcaaccacagtatcaaagccggcagaggcattgcacaccggtcccccaatccatactaaaaatctaattgcagcaactgctattgctattgttggctttgtacaagccgttattggcgtttatggggaaggacaatttatctagtgtttctcgttcacgtatttatctctacaagaatttgtagctgcctgaactcggctcctctctctctccaaaaataaagtgtgtagtaatttgcagtttttttatatattcctacgagttttcaaacgttcaaaagacagtatgttcaaaaattgtgcatacacacacgtatgcacatatatacataataatacactgtaataagcacatttgtaggtgctcttgcacttggtttattactgtcactgacttttctcacccggccgagagtcgtgcgaaaattcgcatgttaaagtgagaaaatagagaaaacaacacagctgaaaaaagtattggtaacagttcaatacgtgatcaaatatacagcacgtcgcgcagaaccagacgaagcggagaatattctacattgacagtgcatgatgcctgatgacaattcaaactcgtccactcaaaactcaagcgcattatacaaggacctgaggaaagaatatgaatctcttttcactttaaaggaagattctgggttagagatttcaccaatattcaatgtccttccacctaaaaaggattatcctgactactacgcagtgatcaagaaccctgtatctttcaatactttaaaaaagcgtattccacattatacagatgctcaacagtttatgaacgatgttgtccagattccatggaatgccaagacttacaatacaagagattcaggaatttataaatacgccttagtccttgagaaatatttaaaggacacaatctatccaaatttaaaagaaaaatatcctcaattagtgtatcctgatttgggtcctctacccgatgaaccaggttatgaagagtttcaacagaaattaagagaaaaagctgaggaagtagcgagagctaatgcagccagagccgagtcgagctcttcaatgaattcaacagaagcagccagaagattaagaaagactcgtacttccgtcaaaagagaatcagaaccaggaaccgatacaaataatgatgaggactatgaggcgacggatatggatatcgataaccctaaggatgctgattttcctgatttgataagaaagccactaataaatattaatccatatactcggaaaccattaagagacaacaggtccactactccatctcactcaggcacccctcagccgttaggcccaaggcatagacaggtatccagaactcaggtaaagcgtgggagacccccaatcatcgacttaccgtatattcaaagaatgaaaaatgttatgaaagtactaaaaaaagaggtgctagatagtggaattggtctaactgatctttttgaaagattgcccgatagacacagagatgcaaattactacatcatgattgctaatccaattagtcttcaagacataaataaaaaggtaaagactcgtcgttataaaacgttccaggagttccagaatgattttaatcttatgttaaccaactttagaatttcgcacagaggtgatcctgaaagcataaaaatttcaaatatcttagaaaagacctttactagtctggcaagattcgaactatccaaacctgatagaagtttcattccagaaggcgagctaagataccctctagatgaagtcattgtaaataatatatcataccacgtgggagattgggcacttcttcgaaatcaaaatgatcctcaaaaacctatagtgggccaaatattcaggctatggaagacaccagatgggaaacaatggttaaacgcttgttggtattacagacccgaacaaactgtgcatagagtggatagattgttttacaaaaacgaagttatgaaaacaggtcagtaccgtgatcatttagtatcaaacttagttgggaaatgctatgtgattcactttactagatatcaacgtggtaatcccgatatgaaattggagggtcccttgttcgtttgcgaattccgttataatgaatccgataaaatttttaacaagattagaacctggaaggcttgcttaccagaggaaattcgtgatttggacgaagctaccattccggtaaatggtagaaagttcttcaaatatccttcccccataagacatctactaccagctaatgcaacgccgcatgatcgcgttcctgaaccaacgatgggatccccggacgcgccaccattggtcggtgccgtttatatgagacctaaaatgcagcgtgacgatttgggggaatatgcaacctctgatgactgtcccaggtatattatcagacccaacgattctcccgaagagggacaagtggatatagaaacaggtacgatcaccacaaacacgccaacagcaaatgctcttcctaaaacaggatactcaagtagtaaactatccagtttaagatataacaggtcatctatgtctttagaaaaccaaaatgctattggccagcaacaaataccactgtcaagagttggttcccctggcgcgggaggcccgcttaccgtacaaggtttaaagcaacaccaattgcaaaggttacaacagcagcaacatcaataccaacaacagaaaagatcccaagcatcacgttataatatcccaacaataatcgatgatttaacatcgcaggcatcaagaggtaatttgggtaatataatgatcgatgcagcctcctcgtttgtcttacctatctctataaccaaaaacgtagatgttttgcagcgtactgatctgcacagccaaaccaagagatctggaagagaagagatgtttccatggaaaaaaacaaagggtgaaatattatggttcagaggacctagtgtgatagtaaatgaacgaataataaattcaggtgacccacacctaagcctgccactgaataggtggtttaccactaacaagaaaagaaaactagaatacgaagaagttgaagaaaccatggaagatgtgactggaaaggacaaagatgatgatggcttagaaccggatgttgaaaatgagaaagagtccttgccaggcccatttgtccttggattaagaccctcggctaagttcacggcgcacagactctctatgctgcggcctccttcgtcgtcttcatgatcacctttattgtaaaagcaatggcagcataatatcttcccattgcgcattaccctccgcgagcagagtcaaacttcaaacaaagcaggaaaatgaaataaaacagaagttattatatagaagaaagtcatctatagatatattatcgttgtattaatagtagccatataaaacaattatacttcatcaccaacctctcaaaatttcttccccaaggaccaaagcttttccagtaagttgctacaactaaagtgaaataaactatccgaattatataaaagatgcctgactacgacaattacactacgccattgtcttctagatatgcctccaaggaaatgtcagcaacgttttctttgagaaacagattttccacatggagaaaactatggttaaatttggctattgctgagaaggaattgggcttaactgttgttacagatgaagcaattgagcaaatgcgcaaacacgtcgaaatcactgatgatgaaatcgcaaaagcttctgctcaagaagccattgtaagacatgatgttatggcacatgttcatacatttggtgaaacttgtccggctgctgcgggtatcattcacttaggtgctacttcctgtttcgttacagacaatgctgatctaatcttcattagggacgcctacgatattattattccaaaacttgttaacgtcatcaacagattggctaagtttgctatggaatacaaggatttgcctgtattgggttggactcactttcaaccagcacaattaacgaccttgggtaagagagctactttatggatacaagagctattgtgggatttgagaaactttgaaagagctagaaacgatatcggtctacgtggtgttaagggtactactggtactcaggcatcattcttggccttattccatggtaatcatgataaagttgaagcccttgacgaaagagtaactgaattattaggtttcgataaggtatatccagtcactggtcaaacctactcaagaaaaattgacattgacgtattggctcctttgtcttcttttgctgctactgcacacaaaatggctactgacataagattattagccaacctgaaggaagttgaggaaccttttgagaaatcacaaatcggatcctctgctatggcttacaagagaaacccaatgcgttgtgagagagtgtgctccttggctagacacttaggttccttgtttagtgacgccgttcaaactgcatccgttcaatggttcgaaagaactctggatgattctgctattagaagaatttctttaccaagtgcatttttaaccgcagatattctattatctactttgttgaacatctcatccggtttagttgtgtatccaaaggttatcgaaaggagaattaagggtgaactaccttttatggctactgaaaatatcatcatggctatggtagaaaagaatgcctccagacaagaagtacatgagcgtattagagtgctctctcatcaagccgcagcagtagtcaaggaagaaggtggggaaaatgatttaattgaacgagtaaagagggatgaatttttcaagcctatctgggaagaattagattctttactggaaccatccacttttgttggtagagctccacaacaagttgagaaatttgttcaaaaagacgttaacaatgctttacaacctttccaaaagtacctaaacgatgaacaagtcaagttaaatgtttagaagcctttacatgtacaaataatatgtttattaccctattatatgttactaatgaaaaaaataacaattctttatttatgtacaatgcaagtagaattccctaaatagaagttaactatttttattttactgggatatatttttcatcttcttccttcatactcctttcatttttcttgtttttttggcttacggattttggcaatgtttatactttagaaaaaaaggaaactcataatgctggcatacttgaaaaaccatacggaaagatcgtagtttatttttgtaataagacactgaagtcagctgtttgaaagagtatattgaattgatggttttacctattagggatagtaatcataatttaaaaatatgaaacggttcttactcagtcgaagacagagacaccttcgtatgatttgctttcacaatataagtctctttagagctaatggtgactccaaattgatcaaggaatatggtgatggatttataccatgtttctttatcttggaatccataagaggggagctgctttatgtgagcgaggtacaatcaggttctttgcgtaaactctcttttcaggaattaccaaaactaactggtgcatctactatgattgtcctaaaattggtaggactagttccgagtgatattttgtgtaccataagttcagataaaaatggtatcattgacgataaatggtgcgttttatgtacctacacgatagatcttaacaagttacaacccataaatgaagacacagttctaattacaggcaccaacgcaccagtacttgatttaatagatggatcctacacattggctgcagaaaaaattaagccactaaagggccttgttagttctcacaaaaggaatataagtcaagtcaagatcaaattttcattggcatatagctctttactaaaattaaacaaactattggagtattcttcccaagtccatgaggaaatcaatgaaatttccagcaaaatagaagatgactttttgtcactcaagaatcaaaatcattggtatatgagaacagtacagaagtccatagaaacgctagaaaaggaagtcctacaaaggaaaaaaagcaagaaaaatatagaaatggcgcaactcgagagtaatgatactatcaaccattctaaaacagaactgtctctgatgtcgcaggacgagtctataaatgatgactatggaagcatatattctagatttgtgcaaataaaagataggttggaccaactgaggtttaagaaactgtatcagctgatagggatcttccattcaacggatttatttaattcagatagaggctatatttactttgaaaaaccttctagcgtaaatgatgttattaataggctcaagctaaaacctttgaatatagagatattacttagacaagccggcgaatccacaaagcacagagaatatgtaaacagccagttgggttattaccttttatttctccatttgacagccatccaaattttcaaggctcctttaccctatagactaatgtattatggtagtacatcagtgatcgacagtcaatatccgttgtatttcactgatcaaatgatttctaagcatcaagcaaagctgattaaagccatacattattttaatgctgatatattgcaatttaaacagattctggagaattaccgtccaacatagactgaaaatcaaaaatctcttttggactgccatttaatcttttccatgtgtgtatattgttctcatttacattaatttcataaatacggatacgtctttctgtacctccatagccagcataaccaccttctccacctccaccgccatagcatagccagattttgttcggcgtagagtcatctcgaagacagtaatcgttacaatggtcatgtccgcaactgacgacatccacacttaacctatccaaagttgttatcccctcagaattatacttaggtgcagtaacaccttctttgtacattccaatgaggggatttttctctccgggatgtgtcttggattcaatattcaagtattctggcagtgggatgtgaaaaaatgccattgaaagacctgttttgaacttcaagttcacatcatgataatcttcaatgtatttccactgtgattccttaatccaatcatatccaggataaattttaccaaccgtagaatatttatgtgagtccagaaaataaagtgtacctactgggacttctgtatcattgttcgaaaaaatctgataaatataattaccaacgccaaacgtattatcgtgtgtatcatggggactaaacttgaaaagggaatatggtagtactgaagctatttcggataactgccagcgcgttaagcttccctcgtcgtcgtgatttccccataccattgcccacggaatttttcttgcaatgacgggtgctaccgcctttaataatacggtttcagagtcttgaatagatctatcacccatgatttggtcaccagtaaaaacaaccaactgcggtttttcaatgtcaagaacttgttgaacgaaagtttccgtttttggatctgccttgcaagcttcatgctttggatactcatcgatacattcagactcccccacacccaagtggagatccgccaactgaacaattttgaactttccttcatcagtttcttgcagccgttgagctcctgtgtctacaggacgagtaccaacgaatttgtaagtcaaataagcaggttcgctgtagcggtattttactaagggaaattctttttgaagagtccaatttgctatcggctggatgcaatcaacaccaaagagaatgttaatatcgcttatgtagctccttttctgcaatagttctatgctaataggctcgaatgtgatggatacatccataaagggtagcgatttgtctttaggatatttggaaattccagttactgcctcaacatttagcttttctaggttggatccaaagtagtccaccaaagcagggtataacacatcatagtaaaggtattctgactttccaaaccacctgcgtccaaaggaacctctcaagtctttatgaattcttttcctttgtaagtattggtgcccatcagttaaagttgatttaagttcatgccgattaaaacatccttcataaaaacgaccaatatgaaaacattcgtcatagcctatatttacaactagcttatcgtcatttgagaatccctctagacctttattttggaaccatagattatcaacgtgtgatatcgggagtgcaaggtcgaaaccaatgtgctcttcaactcttggcgcctgtaggaagtaaaatagggcaatcactacaaaaactaccaagtataataggtacctttgatacagcctcggtaaccggatcatgttaagatttttaaccacggtgctggtcttcgatacttaagtataaaacttgtatcagaggtatctgcgatctaaaaagattaatttttgaaaaagatcaacactaaaccatttgaaattcaaaaagcacctaaggcaaaatataaatctaaatatacgtaaaatggaaacactttctgcgcagctttatacaagttagccttctagcttatgaaatagaaatgaaatataactgagcaagtcctatatacaatactattaatgatcttcttgtccatgagactgttcatggtgccttttagagacttcttcatcacttatctgaggcctgtggccacccgttctcaataaaccaccggcagtatcttcaactggaaatcttgcactgggtcttacgcaatggggcttgcgtaactgttcaaaatccatgattttagttttccctcccccttttaaagtaatctttggattctcgcccaacttttcctccacttcttttatattttgggtgcgttctttactattactattattattattattactaactgccattatagtttctttatgctgtcctcaccatgcctttcgttatcaggctagcattaaaagccttttaaggtgtaaagctttcgccgcgatggctttaaacagtagaaaatattcatatttacacacatgcataaagagagaccacttaataaagctagtatgataagatcaccggtagacgaaatatacatggaacagacacaaacagcagagggcactgacttactaattggtgacgaaaagaccaacgatttaccttttgtgcagttatttctggaggaaataggatgcactcaatacctggatagctttattcagtgcaaccttgtcacagaagaagaaattaagtatctcgacaaggatatcctcattgctttgggtgtaaacaaaataggagacagactcaaaattttaaggaagtcaaaatcgttccagagagataaacggattgaacaggtgaatagattgaaaaacctgatggaaaaagtaagctctctatccactgctacgctatcgatgaattcagaattgattcctgaaaagcactgtgttatatttatcttaaacgatggttccgctaagaaagttaatgtaaatggttgctttaatgcagattctattaagaaaaggctaatcagaagattgccacatgaattattagccacaaactccaatggagaagtaactaaaatggtccaagattatgatgtgtttgtcttagattataccaagaacgtactgcatttgctatatgacgtggaattagtcactatttgccacgcaaatgatcgtgttgagaaaaataggctaatttttgtttccaaagaccaaacaccaagtgataaagctatatccacatccaaaaaactatatctaagaacgttgagtgcattgagccaggttgggccatcctcgtcaaatttgttggcacagaacaaggggatttcgcataacaatgctgaagggaaactccggatcgacaacacagaaaaggacagaattagacagatttttaatcagaggcctcctagcgaatttatttctaccaatttggccggatattttcctcatacagacatgaagcggttgcaaaagacgatgagagagtcatttcgccattcagcaaggctaagcattgctcaaagaagacctttaagtgcagaatcaaataatatcggtgacatactattgaaacactcaaacgctgttgatatggccctattacaaggattagatcagacaagattaagcagtaaacttgacacaactaaaattccgaagcttgcccataaaaggccagaagataatgatgccatatctaaccagttagaactattaagtgtagagtctggtgaagaagaagatcacgatttctttggggaggacagtgacattgtttcattaccgacgaaaattgccacgcccaagaattggttaaaaggtgcttgcattggatcaggcagttttgggagtgtttacttgggcatgaatgctcacactggtgaactaatggcagtaaagcaagtggagataaaaaataataacattggtgttcccacagacaacaataaacaagccaattctgatgagaataatgagcaggaggaacaacaagagaaaatagaagatgttggggcggtaagtcatccaaaaaccaatcaaaatattcacagaaagatggttgatgctttacagcatgaaatgaatttattgaaggagttacatcatgagaacattgttacttattatggtgcttctcaagaaggcggaaatttaaatatttttcttgaatacgttcctgggggttcggtttcctccatgctgaataattacggtccatttgaggaatcactgattactaatttcactaggcaaatactgattggggttgcgtatttgcataagaagaacattattcacagagatatcaagggtgcaaatattttgattgatatcaaaggttgcgtaaaaattactgattttggtatttcaaaaaaattatcacctttgaataaaaaacaaaataagagagcttctttgcaaggttccgtnnnnnnnnnnnnnnnnnnnnnnnnnnnnnnnnnnnnnctggatgtcaccagaggtggtcaaacagaccgctactactgctaaagcggatatatggtctacaggatgtgttgtcattgaaatgtttaccggtaagcatcctttcccagatttttctcaaatgcaagcgatcttcaaaataggcacaaacacgacccccgagataccttcctgggctacgtcagaaggaaagaatttcttaagaaaggcatttgagttggattatcaatacaggcctagtgcccttgaattgctgcagcatccatggctggatgcacacataatttgaaaaagggctacttattaattctttttatggcactaaagtgctctggccgattttttatcaaataatacatatatatcatatttagtgacatttattgaatatatctgctatttaccggtttttttttttcaattacgctgattaagtaatcataaatcacaattgtgaaaaaaagaccaaactagatgacggtatttgattctcatacccctggaataaaatcaagtaagataattctgataaaaaaatccgaccgcacagatggaagcacgaagaaacaggcctttctttgcgaggtgatatcaaaccattgatatcttctcaataacctgctctaggaaaaggaggtagatagacaaaagcaaggaaataatccatagagtttcattcacatgaataatctgttaccaatttttctcataagataaagccatctatcaaaaatgatattgaaatatttgaaaaatgcttgtttttatggggaccacaattcgcctgtacctctagaagcgtaaactgttttattgaagttagtcctgataatttctctaccgttttcgctttcttccttagtgccattttttagcatcatattattgaatttttcactttctctaaatgatttatcattcatgtccttggacaagattgaatctacatcaacaattgaacaggaaggaatattgcattgcatggccatttcccggatttgaggatcttcactaattaaaaaccaatgtagcccctcatttccttctaggtagcatttgtaaatacaacttttcaacaaattctttaatctcttaggcaattttgcaatattaatctttccagaactatcattatgttccattacatctgaccataaaataatgtctaaaacttcgggaaattcgataaaaactttcaaattagcaaatttagaatcatctaatctatcgataaacttcaaggattctcgagctgcaaaacttttacgcctttgttgaaggaaatccaattcatttaatgtgaatgttggaatataaaagttcaaagtcacagcttctgtacagtccgagcaccacctcttgatgttgcctagacccttttcaaaagctgaagcatctataatgaaattatattgtgtcattaacctgctttttgaggagaccaaaattggaaagaaagaaggtgcttatatttcacgaatgaatgatattagcaggtgtaatattcttctataacaccactacactaacttttaaattaaagccctcttcattgttacttcaaatcaatttctgagattatgaaagtcgtcacgttttacgaaggtattgaatttttcaggttcttttggaaaatagtagtatacatcagtttattaacgatgagatggtattattacttgcaccttttgtaaagataactagtattcataaagtccataagctacaatatgcctcaaaaaccacttaaagttactaagaaagccaaggacccccgtagggtcacaaagaaacaaaaaaatttgagaaaagctgccccattgcaattgaaatcaaaaaagaaatctttgcaacatctgaagaaattgaaaaagagctcttcccttaccgaaaccactgaaagattagttgcgagtaaagtcgggcatttggagttgttgagaggtactagaaaggagttggaaaaaggtaagaagaactctaaatgatttcaagtgaataagattcgcccatcattgaaaggtatttattttcgggtaaggactatctaggtacatctcatcaaattttttatagtccaatttgatcctagtgtttgtatattagctttgtaacttctaagttatccaatagaaaaaatgcgttgcttttttgtttcccgcgagaaatttaacaatatggtgaattaagtgttgatgccacagtttgtaaaaaaaatcgacacaggtttgctatttaagcagacgtaagtgttgtaaaattatgtattcccagtttggccagaagaggagtaaatatcgcatatttatagaataagtacaacatcaaataatgtctgcctttgttactaaagctgaagagatgatcaaatctcatccatatttccagttatccgccagctggtgccccgactgcgtctatgctaattccatttggaataagttgaatgtacaggacaaagttttcgtttttgatattggttcacttccaagaaacgaacaggaaaaatggagaattgcgttccaaaaagttgttggtagcagaaacttaccaacgatagttgtcaatggtaaattctggggtactgagagtcaattgcatagatttgaagcaaaaggcactcttgaggaggaattgactaaaatcgggcttctgccttgaacaggttggatatttttatattaatatgtacgtaatatgtctggaatatttcgaaaacacgggtaagcaaataaaggcctcccattcttccttctatagaagcgtgagcgcttcctcattaacctcttctttagcagtccatatgtaaagatatccaagagattgttcccataaaacgttgacgctaagcaccttcatcagtgtcatatagaaagacagcgctccaagcaccatttccgttttctttcattttggaatggttaaataatgactatctatgatagtttaaaaataccaatatcatagaagatgaaagtcaaatatatgactaaaaatttaggtgaaaaatgtaatttaatgtatacctttcatttacaaaatgtcaaagactttacacagtctccgcgtcaaattatcacatgaatgtacaatcacttttctgactgctctaagctatgtcattgcgatgcagaatttcactgccgcatagacaattttgtgtttcttttgacggtgaattcatactcatctgttccgtttatgcacatttacctcccacttcgctcttagcgattttatgtcacacaacaactttattcgtttatgccggactttcctacttatacataatggaaaacttaaaataattttaaaaggaaagtttctgccacatataactagttctcttttcttatatgcaattcggttgcatacttaaaagtaatcagaccgaatgaacatgtgcctttgcattacttcttttcaaaggacatctctttgcaagctaaccatctgaaaggccgatgaatggtcaaaggacgtcattcaaaacgcaaagggaatttccacattattttacgtaatgcttcgttgttacaaagacagaaacttgacaaatcaaggtcaactggatcgttgctcgaaagtcgccgtcagccatgcgttttactttcgtttgcaaaactccttctcttgtgtatcgtatttagcccgaaattagactataccaaaaaaaagaccaagattcttaagcttcatcaatcctttggaactgcaattattcttacaatctttcatttacatggctcaagaagtgttgctgctcaaaatttcattctatttcatgattatttacattaaacaagtatgatccgttattcttctcgcaaccggagtgctcgagaaatgccagtaagacgacaccctatttttcaagtccagcattggaagacttccaatgaacactcttatcattattctttatgcattacgtttcgcagtaatcctagaaccctaactttttctaaaattaccgtcaaaaatgaaggacgcaacttttctcagaaatttttttttcatttctcttaaaaagttttctacgctggataaattgttctcttccctttgaaatatggagacgttcaaagtcaatttccacacatttaaggtgaacaaataaattataagataccacattaacaacaagtatgtggacgaggtgtggtaagatctccgctgaggttgattgaaaagtattgggtaaatttgtactttttgtctgctgctggtcgtttgtctttcgttttaaaattgcgctagacaagtaaacagggattgcttaagaatcaaagtagcttaactctaaagtaatattttcctcagttgtgggcccatgtgttggagggaaggaatatattgaaatgtaaatgttcttaagttcggttgaacttggatattgttacaagagttctagtctttgataccatttttacgcaattacaaccgcattatttaccttttcatcttcagttttacggttcagtttattctgttacgaaagaactatggtgattcaaaggcgaagtgcgtaggattgtaactcctatacttttaggatacttacaattttgtactgttttcaagaccactgtaaccgataataaaccggaggacacattttaacccactattttttcagaagatcagatgcgagagctcgaagcataagtataatactaacgtttcaaaacatagtaattaggtaaaaaatgactcgctcttccgttttagctgatgctttgaatgccattaataacgccgaaaagaccggtaaacgtcaggttctattgagaccttcttccaaggttatcatcaagtttttacaagttatgcaaaagcatggtatgttccaactatttttcaatattttcacatgtgtttcaatttccgcttatttttaaatgttaccacgaggtttgtccaagttcaatgttgcgcaactctaacgaagaaataattattgccattgttttttactccgggctgataactagatggtgtgatcgggcagtatactaatttatactggacaaagactcgttctttgtgcttagtcccatactgttttttaagtgtccgggatatttaatcccatgtggaaatgcttcttacacggttatggattgcacctcatgtgtagctactatatccattaccgtttacttttcctcaaaatctcactcttaaaattttcaatggcaaaattcttccgcacaacttagacaacattttcttgttttttatgaagtaagcaaaaaattcgaatcaacaacgctctatgagattcttcaatactaacatttactccttatttaggttacattggcgaattcgaatacattgacgaccacagatctggtaagattgtcgtccaactgaacggtagattgaacaaatgtggtgttatttccccaagatttaacgttaagattggtgacattgaaaaatggaccgccaacttattgccagccagacaattcggttacgttattttgactacttctgcgggtattatggaccatgaggaagctagaagaaagcacgtttccggtaaaatcttgggttttgtctattaagtaagtttttagtagtggtacatatataatattaattcttatatccgtcttttctctttggttattttctcagcttcagatattcaaggaaccgtatttttgcgtaatagcgaaaaattgtttatgttacataataagtgaaagctggaggagcacatgtatagaatcgaagagaaacctgaacaatttttcggtattagttactaaaaggctcacatatacatgacaaagaggagaaacctctttatggttggttcttccttcacaatagatcatttacctccagaaatatggctttgtatttctaagctgctcgggacgtctgacctgcataacttgtgtttaattaacagaagattgtatttgacaattacaagtgatgaaatttggaaaagaagatgctatgaccgatggataaatcgagaaaacttagatattttaactggtaatgattacgattctatacccgtctctcaatggtattcttactatttaagaagagcaaaatgggagaataaaattttttgtctattatgggggttaactgaagaaacaaatccccaacatttcagagagaaatatttgcatatcctccaatttagacattacaaactggctacatttctgcataggattataaaacaaggctacatacctgataaaagaccacttgatttaatcacgtatgcaaactatctgttgaaaaatgtgcgacataagtacgtatttcctttattttatcccacaaatgccgctgaattgaaaaatcttaataatatggcctcaagggatgctgaaatgatatatttaagattatctgccattgatacgtcttttgatgacttactagatgctagagaattcatattaaatggaatatgctccgatctactacaaaagtataaaaaaattgaagagtttttgaaattacgaccggtgactagggtttccaagttaatctcaatcagtactgactatctggactgcttcacacaacctcatgattcagtgggtcaaacaaatgatagggccacaggaagggagctacatagagaggatttcatgttactaagagtatattcccgagaaggacgaggttataaaactattattctagcaataatacaggctatcactaagagatataacgttgattcatatcttgctcgagatcatttggtggtgtctgaaccagactttccagatggacgggcatttgttaccgtaaatgaggatttccagccatacatttttgataaagaggaccttttgagcgtttggtcgaacaacttccataacgcagaaaattttgaaagtacagttttaccagcattattagaaccaatatcgatacaacatcttctgacggagttctttcgagaactgctgcgatgcaagcccaggccatttgagggatatccaaacagagcacacggattacgcgatatgtttccatacggaaaagtggaagttcccagagatgtgacgatgtattttgcatttatatacgatcttttcgatggcatgtttgaatctggaatgacaagtttacggggccagatgttgagagatttactgaactacgttaacgctaataattttggtgatttgaatatcatcattggacaaaatgctcttaaggaaccaaatgactgctggtccaacaagagggattacgttcttcttgatgacaataataagattggatatttctatacggatattgaaactgaggatactttatgtgccttaaaccaatatgaagtggacggcaaagtttttataacaacaatagatatcttgggtgatataagagtacgcctggctgaaggactaacgccttttcagggagataatgataagttgtgggagagcttttcttccgttattccacgaactgactggggactttttttcaaaggctatgacaaagaaaggcgtagaatgcaattaaacccttacatagaggaaaagctttccaatctagcgaatgatgaacagcctttacataatttatagtcatatttaaggagttttccaaaagtagcatcctgacacattctattacacctttttttatcagcccgagcggcctttccttaacggtgtatacattttctaacagtattaagtcaaaaacaacagcatcaaaagtacgactacttttacaagatttctttagatatttacttcacatagaagaagaaaatcaacggaataaaaatccaaaaatcatgcttaaatctggtagactcaactttctcaagttgaatatcaattcacgattactatactcaacgatccctcaactggctaagaaggtcattggtatcgacctgggtaccacgaatagtgctgttgcatatatccgtgattctaacgacaaaaaatcagctacaatcatagaaaatgatgaaggacaacgaaccacaccatctatagttgcctttgatgtcaaaagctcgccacagaataaagatcaaatgaaaactcttgtagggatggcagctaaaaggcaaaatgctattaattctgaaaacactttctttgctacaaagagacttattggccgtgcattcaacgacaaggaagttcagcgagatatggctgttatgccatataagattgtcaaatgtgagtcaaatgggcaagcctatctcagcacgtctaatggtctcattcaatcaccaagccagatagcatctatattactgaaatacctgaaacaaacttcagaagaatacttaggcgaaaaggttaatttggcagttattacagttccagcatattttaatgattctcaaaggcaagccacaaaagatgccggcaagttagctggcctaaatgttttgagagttattaacgaaccaactgcggccgccttaagctttggaattgatgataagaggaataatggattaattgcagtttacgatttgggtggtggtacatttgacatatccatcttggacattgaagatggcgtgtttgaggttcgtgctactaatggtgacacgcatttaggtggagaagattttgacaacgtcattgtaaactatattatagataccttcattcatgaaaaccctgaaattacacgggaagaaattacgaagaacagggagacaatgcaaaggttaaaagatgtttctgaaagagctaagatagatttatcccatgtgaagaaaacttttatcgaacttccatttgtatacaaaagcaaacatctacgagtgccaatgacagaggaagagctggataatatgactttgtcattaatcaacaggactatcccacctgtgaagcaagcattgaaagatgctgatatcgaaccggaggatatagatgaagtaatccttgttggtggtatgacccgtatgccaaagattagatctgttgtaaaagatctttttggtaagtctccaaattctagtgttaacccagatgaaacagttgctttaggagcagctattcaaggtggtattctatccggtgaaataaagaatgtcttacttttggatgtgacaccattgacattagggattgaaacatttggaggagcgttctcacccttgatacctagaaatacgacagttccagtaaaaaaaacagagatatttagtactggtgttgatgggcaaacgggtgttgatatcaaagtttttcagggtgaaagagggttagtgcgtaacaacaagttgattggtgatttgaaacttacaggaatcacccctttgcctaaaggcattccccaaatatatgttacttttgatatcgatgcggatggtatcatcaacgtatctgccgctgagaaaagtagtgggaaacaacaatccattactgtaataccaaattctgggttaagcgaagaggaaattgcaaaacttattgaagaagcaaatgcaaatagggcacaagataacttgatcaggcaaaggttagagcttatctctaaggctgacattatgataagtgatactgagaatttatttaaaagatatgaaaaactgatttctagcgaaaaagagtattctaatatcgtagaggacatcaaagctctgagacaagctataaagaattttaaggctaacgaaaatgacatgtcaattgatgtaaacggaataaaaaaagctacggatgcgctacagggtagggcattaaaattattccaaagcgcaacaaaaaaccagcagaatcaaggtaaataagtgaacaaaacacaaataagacttgtatattaacgtgtatatcgttcattaaagcatattttgacgtatttatactttatacatttatatatttctttcccgtttcaaattttcggttcaaataaagttgcatgtggattattatgttcccataaattctagtttttattattttccttgcaccgtatacctttatagagatttgttcatgaatcttcttcttgtgaacgccaaccaaaactttgagggatattccttagaatctgtagagctatagactctttctaatagtctcattgccaattcttgacggaattgctgaatataagtcttcaacaagtccatcgaattatgatcttgtactggaacttggtaaacattattcagagggaaacccggtgtacctggtaaagtaaagttgtccaaggccacattggttaacactttgacggcttcgttaaatgacgttgttattttcaaatgggctaggcaatcattgataaagagaattccgtagatgagcactctgtcggcgggtgatttaatttcaaagttcttgaagaaggaattggcacgaaataggtccaagcactcgtcgataatatcgtaatcggaattgctggggtatgcaggacccctgaacttagtgttcaagggcagaagcgcaaagttccctaccatgcggtcagtgttaggatctacagggaaagtcgagtgatacgcaggcatttattaatatactgggagtggagagactgataataccaataatcttcctttattgatgtttgttactgcgcaccaagtgtttaattcattgttattcattgttatactaaaccaaaccgcaacggaaaggataggggttcgtggtggatgatccgcgcaacggccgagtctgtgaaactgagagagaatgatagtgaaaacaatggtatggaagtccgaggtcctaaggcttgaagaaagtttttaaagggcattatgaccagtgagtactgacgacctaatttaataacagtattgagccgattaggttttcttggatttttttttttgctgttttatagctatttttttatttgttgtttgtggtcattaatatattcattcgctctgttagtgtaatcgattacagtgctctattactgctgacttaattggacaattcatctcttttcctgcggttatgagcgaaaccaacgttgacagcttaggggacagaaatgacatatactcccaaatatttggtgtagaaaggaggccagattccttcgctacttttgatagtgactcgcacggagacataagttctcagctgctgcctaatagaatcgaaaatatccagaatctaaatgttctgctttctgaagacattgctaatgacatcattattgccaagcagaggagacgttctggagttgaagccgccatcgatgattctgatataccaaataacgaaatgaaggggaaaagctcaaattacattttatcgcagcagactaatattaaggaagttccagatacacaaagtttgtctagtgctgataatacacctgtgagcagtccaaagaaggcaagagatgccacatcttcccatcccattgttcatgctaaatcgatgtcccatatatattcaacgagtaatagtgctagtagacaagccaagcactataatgaccaccctttgcctccaatgtctccaagaaatgaagtttaccagaagaataaaagtactacagcttttgtgcctaagaggaaaccttcgctcccgcaactagcacttgctggtcttaagaagcagagcagtttttccaccggcagtgcatcaaccactcctacacaggctagaaaatcgcctttgcaagggtttggtttcttttcgagaccaagttccaaagacttgcacgaacagcaccaacatcaccagcatattcagcataataatattaacaatcataataataataatactaataataatggcgcacattatcaagtgggtagtagtaacagtaattaccctcaacattcacattctatatcatctagatcgatgtcgttgaactcatctactctaaaaaatattgcatcatcttttcaatcgaagacttctaacagcaggaaagctacgcaaaaatatgatataacttccaacccattctcagatcctcatcatcatcatcatcatcatcatcatcatcactcttcaaacagtcacagtagcctaaataatgtccacgggtctggaaactcctcaagtgttatgggaagctcgtctaatattgggttgggtcttaaaacgagagtttcttccacctcattagctttaaaaagatacacttcggtttcaggaacttctctatcttctccacgtagaagtagtatgacacctttgtcggcatctagacctgttatgagcgcttcgtcaaaaaaacctcaggtatatccagctttgttgtcaagagtcgccacaaaatttaaaagttcgatacaactcggggaacataagaaggatggattagtttaccgtgacgcatttacagggcagcaggcagtcgatgtcatctgtgctatcattagaacttctgatagaaacttagccttgttatttggtagatcactagatgcacaaaagctgttccatgatgtggtatacgagcacaggttaagagattcaccacatgaagtttacgaatttacagataactcaagatttacaggaacaggttccacaaacgcccatgatccactgatgctactcccaaactcatcgtcttttaattccgggaaccactcttatccgaattccggaatggttccatcaagttcaacttcatctttgaatagtgatcaggcaactttgacagggtcgaggctacatatgagtagttcattgtcccagcaaaagaaccctgcagccattcataacgtcaatggtgtgtttacattactggcggaatgctattcccctacgtgcacaagagacgctttgtgttactctatttcgtgtccaagacgtcttgagcaacaagcaaggttaaatctgaaaccaaatggcggcctgaaacgtaatatatcaatggcattggatgatgatgacgaagaaaagccatcttggacaagttccgtatctaaagaggattgggaaaacttaccaaaaaaggaaataaaaagacaagaggctatttatgaagtttatatcacggagaagaactttgtaaaatcattagaaattacaagagacacattcatgaagactttggctgaaacaaatattatttcagcagatattagaaaaaatttcatcaagcatgtttttgcacatataaacgatatctattcagtgaatagacgttttttgaaggctttaactgataggcaaagaagttcaccagttgtgagaggaattggggacattgttttaagattcattccattttttgaaccatttgtttcatatgtcgcttcaagaccatatgctaagtacttgattgaaacccaaagatcagtcaatccctattttgctagatttgatgacgatatgatgagctcctccttacgtcatggtattgattcgtttttatctcaaggtgtttcaagaccaggtcgatatatgctattggtcaaagaaatcatgaaatctactgaccccgagaaggacaaaagtgattatgaagatttaagcaaagccatggatgcattaagggattttatgaaaaggattgatcaagcaagtggtgctgcacaagatagacatgatgtaaaattgttgaaacaaaagattcttttcaaaaacgaatacgttaatttaggattaaatgacgaaaggagaaaaattaaacatgaaggtatactatcacggaaggagttgtcaaaatcggacggaacagttgttggtgacatacaattttatcttctagataatatgctcttatttttaaaggccaaagcagttaataaatggcaccagcataaggtattccaaaggcccattccattgccattgttatttgcatgtccaggtgaagatatgcctgcgttgaggaaatatattggagaccacccagattgttcaggaactgtaattcaaccagaatacaacacgagtaatcctaaaaacgcaataactttcttatactacggtgccaagcagagatatcaagttacattatatgctgcgcaatacgctggattgcaaacgcttttggaaaaaataaagcaaggacaagcagctattataagcaaaacggagatgttcaatgtaacgaaaatgagcgataggttcttcgattacaccaacaaaattaacagtgttacttcctgtgatgggggtagaaaacttctgattgcaacgaactctggattgtatatgagcaacattaaaagacagcagaataaagatcatagacataaaagctctgcttttttttcaactccaatccaactagtacaaagaaataatatcactcaaattgctgtattagaagaattcaaatcaatcatacttttaattgataaaaaattatacagttgtccgctgtcattaatcgaagcagaaggtaatgggacatctttcttcaaaaagcatcacaaggaactgatcaatcatgtgagtttcttcgcagaaggagattgcaatggtaagagattaatcgtgactgcacacagttcatcgcattcaattaagtacttcgagcatgaacatccattattggccgaaaaaaatggtagtggtagcggtaacaaaaaaagtctcaagaaaaaaataaccgaggttatttttgattctgaacctgtctctatttcatttctcaaggccaacctatgcattggctgtaaaaagggttttcagatcgttagcatttcacagaatgctcatgaatccttgttagatccggccgatacatcattagagtttgcactaagggatactttgaaaccaatggcaatctatcgtgtgggaaatatgtttttgctttgttacacagaatttgccttctttgtcaataatcagggttggagaaagaaagaatcgcatattattcattgggagggagagccccaaaaatttgcaatttggtacccgtacatcttggcattcgacagcaacttcattgagatcaggaagattgaaactggcgaattaattcgttgcgtccttgctgataagattcgacttctacaaacaagtactcaagaaatcctgtactgctacgaggattatcgcgggtatgatacagttgcgtcgttagatttctggggttaagatagcaacgtatatagactttccttattttctttagaataaaaagcataactaaagttgtaaaaggagcagaattatgaataataaacattgatgacaatagtggaaaatgacataaataataattttataatataataatgataattcaccgtcagagggatttgtatgcaaatgattgatgacgcgagaaaaaaaaacgcgaaatttttcttcccaaagcttcgaagtttttattccgtccacaaagtgaaaaattttcagaaaattttccagactgtgaataaacaaaaggttggcttacgcatttggcttgtctttttttttttccactggttcttagtaaataattgtataaaatatttatctggagtcttctgtttgttgtttagccttgtttgaagttttatttaacttattaccccagttaggtactgtgtattttccgcatatctggtgtctttttatttggtcattgattggtttttgacagctcttcactcgcttcaagcttacttctagtttatttattcggcttttttccgtttgtttacgaaacataaacagtcatgaacactaccacatctactgttatagcagcagttgccgaccagttccagtctttgaactcttcttcttcatgtttcttgaaggttcatgttccttccattgagaacccattcggtattgaattatggccaattttctccaaagtgtttgaatactttagtggctatccagctgagcaattcgagtttattcacaataagactttcttggctaacgggtatcatgctgttagtattattatcgtttattacattattatctttggtggccaagctatcttacgcgccttgaacgcctctccattaaagtttaaattgcttttcgagatacacaacttgtttttgacttctatttctctagttttatggttgctgatgttagaacagttggttcctatggtttatcacaacggtctattctggtctatctgctctaaggaagccttcgcaccaaaattagttactctttactatttgaactatttgaccaaattcgtagaattgattgacactgtgtttttagttttgagaagaaagaggttattgtttttgcacacttaccatcacggtgccaccgctttgttgtgctacactcaattaattggtcgtacttctgttgaatgggtagttatcctactaaacttgggtgttcacgttatcatgtactggtactacttcttgagttcatgtggtattagagtttggtggaagcaatgggtcactagattccaaattattcaatttttgattgacttggtatttgtttactttgctacctatacattctatgctcacaaatacttggacggtattttaccaaacaagggtacttgttatggtactcaggctgctgctgcttatgggtatttgattctaacatcttatttgcttttgtttatttccttctacatccaatcttacaagaaaggtggtaaaaagacagtcaagaaggaatctgaagtttccggctccgttgcatccggttcttctactggtgtcaagacctctaacaccaaggtctcttccaggaaagcttaaataggaagcgagaatttttgacagcgaatgaaaaagaaaaaaattaaatgttaacattttctttatattaaatatgtacgataaatgaaatcattattatagaaatgatagattattggcttggtgtttttcccattttgattaatcatttccttagctgcccaaagaattgcacgcttacagtgaggagtagtgatacattacaattataaaataaaattatatagcagctaaaatttaaaacaaacagactttgttcctttgtatgtcctatggaagatactgacttgcagtttgtaaagtgtccaagtcgtaatccactttacttgccacgaattgatcattaaataatttaattttaataatctcttgagttaaatcgggatgtactctgggaatgaagtcatttaaaaatgagtactctcccctaatggaggaagatgactgacattgcattatcttgaacaaaattctaattatcggcccagcatcattatctaagtattgggaccagaacgcgttacacacaggaacatggatatcaagtaactcttcaatgaagttcattggttgttctagctctccaataatagagtcctctgttattattctcttcttgaaacggccactatctctaatgaaattgctttgttcacaatacgacctgtaagatatgggtacgatggagtttactgtactcaagtaatcatataggtcctcttgaatgatttgtaaaaagatactatctatttcctttgatatggtagagtccgataaatgatgggtatcgctaagagaaccaaatgataggttattatcgctattctgtggttgttgttccggtaatacagaattttctccaccagtaggatctatatctattcttgatgcgggcgtatttgaattcgagtggttgtcgttgtcgttatcatgttcgttatcattattgtcgctgttgttgccgcttctattgttgatgttgttcgtctgattatcagtgtgaatgttcatgttgctatgattggaagtattatgactgttgttaacgttgcctattgtgtgtaaattcaaaaaccttttcaataaactgaaaattgatgtagaaagtttgtcgactatttcagaaagtgaaatggtatgaaaagaatattccaggacttctctttcgaataaaatcgcaggacacaagaacattgctaaaaggttcatatcgtctgaaaataaaatggttttgaattcttgaattttagacaaaaatgtttcaaatggtgcaattaaccgttgaaattgtaggctgcccaaggtggacaacagatgcttttcaatagacattatggcgaacaaaacataggtaaagtttaagcttttggaagaagtaaagaactttagtattctattgatggaattcaaagtaattaataaatagtctattatttgaaagtcgatttcgttgaatttttcaatttggatagaagattgatattcttctattatgggacgaaggttcaaaaaagtttgcagtgaaacggtggcggtagagtaacgggataaatcgaatttcgaacaaacgaattcgaagccaaatttttcacacaatgaacggaatttatctaactgccacgaattagattgtaaatcatccaaaaaagaattgattctggaaaaaatggaattcgaaatatctatatttgacaaatcaattagagagtccaataaagtcaaaggttctttggagaatgatgtttgtctcggatgcgtaatatcggcggatttaggcgtaccgaacaatggcaatatcgcagaatttattatggaaataatacaattgtgataatagtttttagcattcgtatacgtattcgggaaaaagggttggctatccattacgtttagtagatctactatttgagatcttggtagagtgatagaaagcacagtattttgtaaaccaggtaattcttgtgagattttgagcagttgagctggaatagatagtttggggtcattgttatattcatgtaagttttggatgataaggggtaaagtctttacttgggaatgaaaatcatcatagtactgaatactcaatatagatatcgtgttattccaaacggagtggcttagagagaaaaaattgattttttgcatttcaaataattggttcttcaacctgtttgataactgattagatctatcggttgggtccattagtaagtagtttttgtcgataatcaacgacaaatcggaattgtttcgcaaagctgtcctttgaatgattctatcgagattatatgcgatggacctgatagcattcagaattaagtcatggtcaatgaagcttagtgagttggcgttctgattgatcaaaaggcgtacggcagtgttgtctacgaacgacagaggcaagttttctgatgcaattatgatcgcaagcgactgcacaagaggcaaggccatttctttttccctagttctcttcaaaaagtcctcgtctatttccagcaggttagcaatgctgttcgttgtggcgctaccgccttgatggttcttcaaaggtggtctgaccataaaagtagaacctgcttctacgcccgtccatccgctatagtaattggcattcgggtctatcttatgcgtgctccacaaatgagtttgcgaggcttccgccatgcttatgctgtttccttgccgtcttattatcacaccgcagtacttgcattttactgcctccagcatcttgtctacacccagaaaatggcccaagtagcgtgacctgtctctggtaagcatatatgcgggcacccattcgctaccatcctctgctaacgactccctttcctcatctctatctnnnnnnnnnnnnnnnnnnnnnnnnnnnnnnnnnnnnnnnnnnnnnnnnnnnnnnnnnntttgtggccgtcgtagccgccgtcgccgacgatacagttgaattcatgggaggcaacaccaatcctctttcagcactctgtacctgtgtgtccatcgctctcatatgtgctctcgtgcttgtttatcctgtggatgctgccagcaaactctctctttcccatctcttgatggttcatgttatgtgttgtttattgtttgctgatcccattcgcgctttcccggccgtggtaaatgactacacggtgaataattgcgccattttttcgccgttgcggtgttttttttgtagccgttggaagcatggcagtaccatctggaacaaagcaacggtataaagaagacagactgttggtaagcgctgcatgttggtgacaaaaagttggtttcgagaaatcagggtgggtgttttttgtgtggcatgtgcagcgagcgatgagtaatgcaaacaatagtgctatgaaccacatcacgttgcctcccatctcgtcatttgacaaccttatcaaggcagccgagagacaatataatggcgaggcttcgtccgcctcgacacatccgacactgcctaatatgaacattagtaacggcagtggcagtgcgggcgcatcatcgtcgatgctgagctatcagttgcttccgcactccaatgatgtgtcccggtcgaactccagctcgagcttccttccctccgtgcagcagcctacggaaggttccgcttctgcatcggaaacttcttcatctgcatcaccttcacgttccatttcaccaattttaaaagtggctggtccttcatctgttggcggtgccggggtgagtaccccccatagcaccaaaatcaataagccaaggaaaaagaagcaatgtccaatttgtcgtaatttttatgccaatctgaccacgcacaaggcaacgcacctgacgccagaggatcggcctcacaagtgtcccatctgccaccgcgggttcgccaggaacaatgacttattgaggcataagaaaagacattggaaggatgagatactgtcccaatcgggagtactttcgaaccataatgatggtaagggaggatccgtttctcccaatgatgatgatgcccatgaaaaaatgacaccgatgaattctgtcacagattatgcacaattgaaatcgttgcatcaaatcaagggcacattcaagtgcccattcaactccaccttaatacaattggacatggatatgtacccgtataaactgaaacctttaaattttgagacttccaattgtcaccagacgggggtgttctcacgttgcgacaccttcaaaaaccatttaaaggctttgcattttgaatacccgccaggcacgaagaaaaaggatagaaatgttgttcctggtagatgtaagcattgcggcctgaagttcgagaacgttgacgtttggctcaacgaacacgtaggtaaacaatgcggctataaataccattgattcccggcagcataacgacttttcccctgtttttattagtactagtagatatttaatttatgtatctgagtttttaatgtttttttttccttctcttatcattcttcaagtgcggctatccttctgtactgtggcctgccgtcaacaacttctctgtagattatcagatccattcccttcatgtatgaatcaggtagttttgtggggtacagtgtaacgccgcttttcctcttgattgaccacttatcaactaaggtgttttcgataccattatagaagtctgtgggaaaactcttggtgatgatccagcagcccaaaaattctcttagtttccttagaatcttaaacagtttttcaaatttcgataaatttattacatcatagtttttgtcgctttcaaaattcaagaaagacaaattgtcgatcaatattcctcgtaattgaaagttgaaattatcaacctggcacctccttaacgcatccatgggagagtcatacaataactctagaaatacgattaatcccgtgatgtttatgcaagatagcgaattcatgtagatcgcgccatgctgcctttgcttttgttgggaccatattgatactatatctatgattaggatcttttcgtcccccgtagtacaattcaccaacttttgcagcgctaccgaaggtttaaaatcactttcaatgatgtgcaagaaccctagtttactctcctgctcttcactaattaggtttcttaattcatttggtaggtttatatagttcttggttgatgtgatgaagtttgacaaaggataaattctaatgttctttaaaacttccatcccattccattcgctacttcctttctcttttcctaagaattttcattattagaaggagtaatgcttacggtacacatacatacacatatatatatataaatatatatatatataaggacatatacagattttttttttcgcgtactaaagtacagaacaaagaaaataagaaaagaaggcgatcattgaactactgtgacttgccaatatggtctaaaaatttgtcaatttcacctgaagaacccaaccaaatagaagatttgtcatggatatgacttggcaccaaatccaagattctctctccgcgatcgttgaccgcttttccccctgcttgttccattaagaaagccattgggaaggcctcataaagcaacctcagttttccgttggggctcttcttgtcgcaagggtatgcgaaaaggccaccgtaaagaaacgtcctgtgaacatcagcaaccatggatccaacatacctagccgagaaaggcttgttgttgttgtctgcttggggttgtttgactttctcaataaatgttcttatagtctcgttccagtagagggtgttaccttcattaattgagtagatggccttttgaggcggaattcttaagttaggatgagtcaagatgaattcgcccaagtttgtgtctaaggtaaacccatcaactccatcacccaatgtcaatactagatgcgtagaggatccgtacatggcatagcaagcggctaccatttctttaccacatctcagtacgtcgtttatagtacctgatgagtctggtagcagtctgaatatagacgcgatagttccaacggagacaccggcgtccaaatttgaggagccatcaataggatcacaacacactgcgtatgagcccgtgtttgtgggaaaaacgatcaagtcttcctgttcttcagatacaaggaccttgatgatcccactagccctcatggcattgataaatatttcatcacctagaacgtccaacttcttttgctggtcaccagtgaagttggaagcgcctgctaacccaaccaagttaaccaattcagcacgtctgatggtgtgagatacaaatttgaacgcgaattgcaaggcattcagtactaatgtgaaatcaccagtagcgttcttaaattgcttctggtgctcgattatgaatctaggaagagtgatgatatcggtatcaaacccttcggtagagtctcttcttggtccatttactagagttggcatatgtgtggtagtatgagggatgtttcttatatgttcgcactgttattcttaggcctatcatacaaaaagcaagatcaagacaaaatacacgtctgtaattgcactacttgttgctccatatatatacgtacatttgttagcgagtgaaatggataatattgcctatacataggacgatccttataatatagtgtggggaagatgccacaagttggcaagcgacaggaagaaaccaagcaaaccaaaaaaaaaagtagtgggtattggccagttccgcaatcttcgccttcaaattccctgtctcaactttttaagctttcttgatatgtgggaataccaggctattgctgccttgcgttggctcttacgcccttaacattacctagctttactacataatgagctttcgggcccgcataactccgggtgtccgcacgaccgcgactactaagaataataataataccccggaggtgaattcaaaagcggcgattccatccgtccggaaaagagagcagaagttagcccgggaccatgcagtttgatgggttgtctatcttagactggaaaattcgaagaactcatccttgttagctcagttggtagagcgttcggcttttaagcgcatttgcttaagcaaggataccgaaatgtcaggggttcgagccccctatgaggagttctttactttttttttatcaacttcctttgcttcacgcctattataaatttagatcgcgtatgatattgttaatcggcggttagaatttataaaaatcgacgattttctaggaattatttgcgcatacatatatatagttatttagctctatacaggtgtaagaaggcgttgataaaactatggtaacaaaataaaaaaatagagggaggggtgtggctaaatgcgattttttttttctttggatattattttcattttatattcacatcaaatcagaaaatcctggaacgaggttcttagtaaacccaccttccttggcggcagcttcgtagtagccgtagatggtggtagtagccatcaaaatggatgccccagaacctaaagtacctagtaggtcggagccaacagaaagagcaccgatggtagcaccgccgaaagcagcagcagttggaatgatcttcttcaattctctgtaaatggaggtttctctcttaccgttaatgaccatgccttgatctttgaattgtttggcaatgtcacgtggggaagtgccggagatttcgatccatgtcttggaaaatactgcgcatgaaccaagaacaaatgtgatgtagacgatggtcttgatagggtccagaagagcttcggataaagacattaatggttggatgtagtaggccaacccgctcaaggccatttgagggccctgggtgcccggcctgataccccaaacaccgatcaaacgaatcaatggattggttgggtatttctggaaaaggatttgagagatcaagaaaatgttagaagtcaatgcactctgcaacatgattggggtgttggaagtataaaagagtttgatggggtagataccaatttgacctctcactttggttgacctgatgggcaattcgtaacggaagccttgtaaatataaaacaaagaggaagatggccacggtcatcaacacttggaacatattaggtagattggtacggtaaaaggcctcgacaagggctcttttcttgtcctttctgacagccaaaagatggaaaaaggcaatcacagcaccttcgaactccttaccacgaccggaattgactgtagtaggagcaaacgctctccagaaaatttgttcggcaatattggttgccgtgaacagagaaataccggaacccaagccgtaacccttagatagcaattcgtctaataacatcacaatcagcgatgcaaacatcaattggaagattaacaacaaacagatgggcaatccgaggtccgaaggagcgccgtagttacctgtcatgacgaccacaagggcttggcccaagatcagaataatagcgcacaccttttgagcaatttggaacaactctctgtcctgcttgctctcaggtctgatttgtaaaagctgagtaccctgcaaaaattggaaaatcatagatgaagtgatgatgggcgaaacacccaattccagtaaagtaccacggttggaggccagcatggcacgtagccagtacagagggtcggaagtctcactggacacgatcccgtacagcggaatctggcccagaatcaaaaagatcagtagagaaacgcctgtccagataagtttctggttgtatggaaccttcctttctggagcaatcacttccggcaggaaagattcaaatggcttaaacaagtctagaacacggttggaggacattttcaaagtaaagcgtgaaccagtgtcagtttttctacttgctactatatttaactatgtttttttcttttgctttcaccaactgaaccttgtaataaatggagtgaggttgaattgaggactgaaaaaaaggttagttcggaggccgctgaagtttccgattgggagcaggaattgaggatggagagtgcaaagtgaggtccttgatttgttgtttttacactaaactacgttaccaccgtaacgccaattcaaggcaggaattatgcttgttgtttggcaaaagttgccgaaagaaagaatgagagagaacgacaaagagaatgagagagaacacgtaaagcgaaaaatctggagcgctgccgcgccgggtaacaagtgggaagagagagagagatgtaaggaagatgaatacattcaatacattaaagcttatagcaagcttttagcaggctcaattgcttatagcggtataactgcaacaagagtgaaaattaatatggtgaagaacgacggattcggtatgccatcggaatccagatgcatttctgaacctttccactcgggaaaaccactcgtcatgtcacacggagagttggccatgaactggctaatgggatggtctaagacgaccactgtaagaagaacaagagatgatgcaagctaaagcaagcaggtctcaaataaacgctacttgtgccgttgacagcttgtttatcttgcacatggcaaggccatcgcgtccctgcgtcccaagagtgcgcggtatacgtgcggccttaaacgaggcggtctctgttctctgatatatttcttttctttcttcgttgttttgtttcgtgtttgttgagctcctgccttcaatcggcatcgtcctcttgcgtacgtacataaaatcgttacagctttgttcacatggtgaaaacaatagcgtttggtacgctctttaaatcttggcacttgtcacttacgctcctttaaacaaaatcaaacatacaaatatacggatacgtacgcacacagaagcacaaaagcacaaaagcacataagaagaccacatataagctagattatgtcctttgatagacagttgaccgaagaccaggaggtcgtccttaagcaaatttggacacaccttttccatctgtggcaagttcccgtggatggaactcatattttccctaataactccctccactcctcgtccacccctgctaagaagaagaaatcatcctggtttagcaagcttcagtcctcagaccatacacaggactccagcgaagccgctgaagcggcacacctctatgaaaagggcaagatacacaaggcactagccaatctagacccgcaaacgaccaagaagcagttctggcacgatatcaagaatgaaactccagacgccaccattttgaagtttatcagagccagaaagtggaacgcagacaagaccatcgccatgttgggtcacgatttgtactggcgcaaggacactattaacaagatcataaacggtggcgaaagagctgtgtatgagaataacgagaccggtgtcattaagaacctggaattgcaaaaggccaccatccagggttacgacaatgacatgaggccagtcatccttgtgagacctagattacatcattcttccgaccaaactgaacaggagctggaaaaattctccctgttggtcatcgagcaatcaaagcttttcttcaaagaaaactaccccgcatccaccaccatcttgttcgatctgaacgggttctccatgtccaatatggactatgcccccgtcaagtttctaatcacttgttttgaggctcactacccggaatctttgggccatctacttatccataaggccccttggatctttaacccgatttggaacatcatcaagaattggctggatccggtcgtcgcgtccaagattgttttcactaagaatatcgacgaattgcacaagtttatccaaccccaatacatccctaggtatctgggcggagaaaatgacaatgatttggatcattacactccaccagatggctctttggacgtccatctgaaagacaccgagactcgcgctatgatcgaaaaggagagagaagaattggtcgaacaattcttgactgtcactgcccaatggattgaacaccagccattgaacgatccagcatacattcaactgcaggagaaaagagtacaactttccaccgctctttgtgaaaactactccaagttagatccgtacatcagatcaagatccgtttatgactacaatggttctctaaaagtttgagccaagccacgcgacgctccatactgtatagacctttattataaaaacatctatttctttatatgtccctctatcttatttttcttttacttttatttgtataatacgcgaaaaattatagaatcatttattatcaaaaacaatcaactatgaaatgaaaaacaatacgcctgctaatacggttcgcccttcaatttttgttttttttacatgaatgagtcttatactagatgatatcatcctctcactaacgaatgctaacgaacgaacgccaccacaggcccttaaaaccactttaagcctgctatacgaaaaatcaaaacaatatggtctttcttcgccgcaactacaagcacttgtaaggttactctgtgaaacttccataatagacacagttacaaaagtgtacatcgtcgaaaattgctttttacctgatggctacttgacgaaggaacttcttttggagattattaaccatctcggtacgccaacggtattctctagatatcgcatacaaacgcctccggtcctacaatctgcgttgtgcaaatggttagtgcatgtttatttcctatttcctgtacattcagaacgagaacacaatatatccagttctatctggttacatttatggcaattctcgttcttacagaagtggataactcccctggttatttggcaagccacgacgcccgttgatgtcaaaccttggaagttgtctattatcaagagatgcgctatgcatccaggttaccgggacgctcccggtagtgcgacgcttattttgcaacgatttcaatgtctcgtgggcgcatccagtcagattactgaatcaataattaccatcaattgcaatagaaagactttgaaaagtcatcgaaacttaaaattggatgcgcatttcctatccattttgaaaagaatattatccagagcacatcccgctaattttcccgctgacactgtccaaaacacaattgacatgtacttgagtgaaattcatcaattaggtgctgattctatatacccacttcgacttcaatcacttccagaatatgttccctctgacagtacggtctctctttgggatgtcacttcattggaacaattagctcaaaactggccacaattgcatattcccaatgatgtagattacatgatgaagccatctttaaacagcaatgttttactgccgcgaaaagtcatgtctagggattctctcaaacacttgtactctagtatcattctcattaaaaatagccgcgatgagtcgtcatcaccatacgaatggtgcatttggcaattgaagcgatgctttgcacatcagatagagactccgcaagaagttattcccattattatttcggtgtcctcaatggataataaactgtcttctcgcattattcaaacgttttgtaatttgaaatacttaaaactcgatgagcttacgttgaaaaaggtttgtggcggaatcttgccattatggaagcctgaactaatcagtggtacaagggaatttttcgttaagtttatggccagtatttttatgtggagtacacgagatggtcacgacaataattgcacattttctgaaacttgtttttacgttttacaaatgattacaaactgggttttagatgataaattgatagcactcgggttgacactactgcatgacatgcaaagcctgctaactttggacaaaatctttaacaatgctacttcaaacagattttctacgatggctttcatcagctcgttagatattttaactcaactgtcgaaacaaacgaagtcggattatgcgatccaatatttgattgtgggccctgacatcatgaataaagtgttcagttcggacgatcctttgctattatcagctgcgtgcaggtacttggttgctacgaaaaataaattgatgcaatacccgtcaacaaacaaattcgttcggatgcagaaccaatatatcatggatttgacaaattatctttacaggaataaagttctgtcatccaaaagtttgtttggagtctcaccagatttctttaagcagattttggagaatctttatatcccaactgcagacttcaagaacgctaaatttttcacgataactggtataccagcgctatcctacatatgtattattattctaagacgactggaaacggccgaaaataccaaaataaaattcaccagtgggatcataaatgaagagacgtttaacaatttctttcgagttcatcatgatgagattggccagcatggttggataaagggcgttaataacattcacgacttgagagtaaagattttaatgcatttgagtaacactgctaatccatatagagacattgcagcattcttgtttacatatttgaagagtctctcaaagtatagcgttcaaaattcttagaatatgcatccacannnnnnnnnnnnnnnnnnnnnnnnnnnnnnnnnnnnntatatacatatatatatatatatatatatattataacttccaaaaaggagattggacaatttatatctataaggcattaatatttaactatttacaagcactagtggtaaattcatggcgtcatatgattacttgtggaataagaaactaatcacattgaatttcatgacaaattttttgatttttttattcatcaaatacattctcccttccggtaagttcatcaaagtttcaataacagcatccctacctaatttcaaaaagtttttgtcagccgtgtacatgaatttgactctgccatttaccacaatttgaaactttttgaatttggactcagtagtgcgctcaacttctggccagcggtattggttccattccatttgggagttgatcatctctgcagcttcttctgaaattgacgggacagcaggatatataacggttaccaacttttgtaaattctgtactatcatttcattccttacttcaccttttttcaatgcactttctaaaatattggttagcttcatataatcagatattacagtgtttaacgatagattaacttcaaatgattccgtaattgatttcaagaagcgttggaaatcgttgtgaaatttcacttctgcatcatttaagtcggtcggggtcttgtagtctttacttattgccaaatccttctcgagactgagaatatttttggtcaaatgaagaaccttctgcaaccaacgttctataccaacaatcttggattcatcccaattcagggcatctgcaattggactttggaagaggatatgtgctctcgtagcatcaggtccatgtcttaaaatacattcatttggatctgcaccattgtatttagatttcgacattttttcataagagactaccggaaccttgccatttgatttaataatcactgtgttgccatctggagagtcatttacaaaggttaactcgtcaggcttcaaaaatttaccagaatcggggtcaacataggttttcccttgaaccattccttgtgtcaccagttttttgaatggttcgaagatgccagcagggtcgctccatgcattgatagatccgagaaatttagcaataaaccttgagtataacaagtgtaagatagcatgttctactccaccaatataaatatcaaccggcatatttttacttgcaatttcacgatcaaatggttttgaagtgtttttgggatccaagaatctgaaataataccaagaactatcgataaaagtatccatggtgtcagtttctcttttcgcagggctcccgcatgaaggacaggcgacatttacaaattcatcgattgtggacagcggattcccttttgtatccaagccttcaagttctggtagcttgacaggtagatcactttctggaacggggacaggtccacagttgtcgcagtgaatgatgggtattggagtaccccagtatctttgtctacttatcagccaatctctaattttgtatctaacgacgctcttagacagtccttcgctattcaacatccccattatcgatttccttgccactacagtgagaactcctgagtgttctccgcattctttggttaggacaccgtcagtagatgtgaacgggacagtatcaattattctttgtctttcctgttcagttacttttgaagcatcgtcaaaaaaaggtgctatgcacgtcttgatatgttcaccaggacaatttgtttgccaaaactcaaaatctcggttatcgtgtcctggacaacccattactgcactaggtgctgaaccatagctgctgaccacatatggagctgcaaatatggggacttcctctttagttaagggatttacggcctttatgttaggtaactgaaatccttccttcgtatcgtttggtaattgatcacttttctgtataaactcttttaaatccggcatttcctcgcagtatttttgtacaattgggtggtctaatgcgagagcaacatactgtacagcaaaaagagtttccggtcttgttgtaaagacaatcaagttttcaaatttggggtccgcaactttgaacactaattctgcacccacagattcgcctatccaatttttttgcatttgcttcacgttggaaggccagtccttcagttggttcaagtgctttttcaatttaggagcgaatttcgttattcccaaaaaccactgttttagctgcttcttttccacaatagcccctgatctccaagaacggccctgggcatccacttgttcattagccaaaactgtcatatcaacgggatcccaattaatttctgcttctttacgataagctaagccattttcaaaaagttttaagaaaatccattgggtgaatttatagtattcgggatcacatgtagttatttctctgtcccaatcaaaatttgccagcatactttgcatttgttgtttcatttttgcaatattgtccctagtccatatggccggattaatgcttctttctatagcagcgttctcggcaggtaacccaaaagcatcccatcccatcggatgtatcacgttgtaccctttttgtttgtaaaatctattcaaagagtcgctaatgacataaactcggagatgtcctatgtgaagcgccccagaaggatatggaaactggcacagaatatatttcgacccgctattcagagtatcctgcttaggcaagccacgggttgtcttctgtttccatttctccccaattgcaattaattttttcactgcaggtccagggccccttttagtggataggaatcggcttgaaggtcgagacagcatttttccaccgtacacacacgtcgatttattcacgtacagactctacaatatagagtactagcgccttgtttaacactctgctgtgctccttcctccaagttcttgattctccaccggagcaacaaaacgactttcttcggtttctttgattcttcgcggagataagaaatgagattcttggatcaaaaagtgtgtcagaggtagggaaatgtcaagcaagttcatgaacagaccaggagtagtatggcatggtattaaagatttttctgtggtatttgatagttaggcaaaaggaacattttcatccaagttttatcaaaatttctgttttatagtgaaaattctaagttaaacttgccaaaaacgcgtcgcgtatactaaatttcaatgtttggatctatcaacatgaatatttatatttcatgtagtgaagttcataataagaaaaaaagacaagaggcatataggttcgcaagagataagtagctgctgttaataataataaagagcatattcttgttagattgctaaatggtatgatttcgactacgattagtggtaaaagacctatagagcaggttgatgatgagctactttcactgactgcgcagcaggaaaacgaagagcagcagcagcagagaaaacgcagacgtcatcaatttgcccccatgacacagtttaacagcaatacactagatgaagacagcgggtttaggagctcctctgacgtggccacggcggatcaagataactttttggaagagtcaccttcaggatatattaagaaagtgatcttgcgaaactttatgtgccatgaacattttgaacttgagcttggttctaggctgaattttattgttggtaataatggtagtggtaaaagtgcaattttgaccgccattactattggtttgggagccaaggctagcgagactaacagaggttcctctttgaaggatttgattcgtgaaggttgttattctgctaaaatcatccttcatctggataatagcaagtatggtgcttatcagcaaggtatttttggtaacgaaattatagtagaaaggataattaagagagatgggcccgcttcttttagtttaaggtcggaaaacggcaaggaaattagcaataagaaaaaggatattcagacggtagtggactatttttctgttcctgtaagcaaccccatgtgtttcctgtcacaagacgctgctaggtctttcttaactgctagtacctcacaggataagtatagccattttatgaagggtactttacttcaagaaattaccgagaatttgctttacgccagtgctattcacgatagtgcacaagaaaatatggctctgcacctggagaatttgaagtctttgaaagctgaatacgaagatgccaaaaaactgttaagggaattaaatcagacttcagacttgaacgaaaggaaaatgcttttgcaagcgaaatcgttatggatcgatgttgcccataatacagatgcttgtaaaaatttagagaatgaaatcagtggcattcaacagaaagttgatgaagttactgagaaaattaggaataggcaagaaaagattgaaagatatacatctgatggtactactattgaagcgcaaattgatgcaaaggtcatttatgttaatgaaaaagatagtgagcatcaaaatgcaagggaactgttaagagatgtcaaaagcaggtttgaaaaggagaaaagcaaccaagcagaagcacaaagcaatatcgatcaaggtagaaaaaaagtagatgctttgaataaaacaattgcgcatttagaagaagaactcacgaaggaaatgggcggtgataaagatcagatgagacaggagcttgaacagttagaaaaagctaatgaaaaattgagagaggtaaacaattctttagttgtaagtttgcaagatgtgaagaatgaggaaagagacatccaacatgaacgtgagtctgaattgaggacaatttcacgcagcattcaaaacaaaaaagtggaattgcagaatattgctaagggtaatgatactttcttaatgaattttgatcgtaacatggatcggctcttaaggacaatagagcaaagaaaaaacgagttcgaaactccggcaattggacctctgggttcccttgtaacaattagaaaaggttttgagaagtggacacgttctattcaaagggctatttcatcttcgctaaatgcatttgttgtgtcgaatccaaaggataacaggttatttagagacattatgaggtcgtgtggcataagaagtaatatacccattgttacttattgcttgagtcaatttgattattcgaaaggtagagcgcatggaaattatccaactattgtggatgcactagaattttcaaagcctgaaattgaatgcttattcgttgatttaagtagaattgaaagaatagtgttaattgaagataaaaacgaagccagaaatttcttgcaacgaaatcccgtgaacgtgaatatggctttatcgctaagagatagacgtagtgggttccagctctctggcggatatcgactagatacggttacttatcaagataaaattagattaaaggtcaactcttcatccgacaatgggactcaatatttaaaggacttgattgaacaagagaccaaagaattacaaaatatacgggaccgttacgaggaaaagctaagtgaagtgaggtcaagattaaaggaaatagatggcagactcaagagtaccaaaaatgaaatgagaaaaactaattttaggatgacagaattaaaaatgaatgttggcaaagtagttgatactggtatattaaattcgaaaataaatgagaggaaaaatcaagaacaagccatcgccagttacgaagccgctaaagaagaattagggctgaaaattgagcaaattgcacaggaagctcagccaattaaagagcaatacgattctacgaaattagcattggtggaagcacaagatgaactgcaacaattaaaagaggacatcaacagtcgtcaatctaaaattcaaaaatacaaagatgataccatttactacgaggataaaaaaaaagtctacttagaaaatataaagaaaattgaagttaacgtagcagctttaaaagaaggtatacagaggcaaattcaaaatgcttgtgcattttgttcaaaagagcgaattgagaatgttgatttaccagatacacaagaggagattaagcgtgaattggataaagtctcgagaatgattcaaaaagctgaaaaaagcctaggattatcgcaagaggaagtcatcgcattatttgagaagtgtaggaataaatataaagaaggtcaaaagaagtacatggagatagacgaagcactgaacaggttacataattccctcaaagctcgtgatcaaaactataaaaatgcggaaaaagggacttgttttgatgcagatatggattttcgcgcatcattgaaagtaaggaagttctcgggaaacctttcctttattaaggataccaaaagtttagaaatatacatcttgactactaacgatgagaaggcaagaaacgttgacaccttgtctggtggtgaaaaatcgttttcccaaatggcgctgttattggctacatggaagccgatgcggtcaaggattattgcgttggacgaattcgacgttttcatggaccaggttaacaggaagattggtactactctcatagtgaaaaaactaaaggatattgccagaactcaaactattatcattactcctcaagatatcgggaaaattgcagatatcgatagttctggtgttagtatccacagaatgagagaccctgagagacagaataattccaatttttataattaatgtttcttcatgtaattattcaaaatattgtgtaatcgtctatttgaattcgttttcacggcagcatatttgaaaaaaaaattaatttttacatctaaacataaaaaacctaatcgttttctttccatgctgttatagagacatttattagtacgaatattttcctttctttacgagcactatagacagtaatttatataactaagaaaatggtatgctcaaaaatcaacaatatgactcttagggaaatcatgaatctctggaacaggtatttctgggatataatatacttccccattttcattaaccctttctctatccttttcgctaatagaataaatttctttaacgttagccttcaataaatcaagtacttcaacaaagttcttttgaatttggtgagcttgctctctcatgtttcgtctacaaagaccctcaacaactctcacagcgtctggttttgtttggtttaacctctcaatcaatcttccgactgactgaaccaaatattcttcttcataaatagttcccttcttaccacgagcacgcttacgctcttccctacgcttgtttttagctgtacgtctggaagcaccagtctttgcagtacccccagttttgcctgtgtatctggtgaagaatgattcttgtgttgacgtctcagaaggagcaacagaaacgtcatccgcttgctcagtttcctggccataaaaggcgtatgggttctcctccttcttcgcgcgtagctctctcaatcttcttaactgtgaattaatctggcctttacaatcggcgagtaattctgcaattataccaaaaccttcgcctaaaccgggatcgacaacttcttccaagagttcatctttcttggcctttatcgccacaagagaagcaatatcatatctataggccttacagtacaaagctacggcttctttaacattgtccaaatattccaattgaatatcagcagcatcaacatatctatgttcaaaagtcaaagaagatatcaactcttctgcgactgactcaacttcctctgggaatttctgaacagcgatggacatggcctcacgccatcttttcgctgattggtatgcccccattgcttctttgagctttcctagcatctcgtacgccaccgccgcatccgtatacatttgatttgatgacaaatgctttgcgtaaatgttataaataacattctgcttctcagaatcataacggtaaagtgctaaaccatgcttatacaaatcatgagattcaacatagtctatgacttcctctgaaacattaccatctttatcaatttcggacaagtgttccaaagctttttcatagttccctaagtaatcatcaatcaaaaacttacggcgtaaaggctcattatcttgtaattcttgtaaaaatggcagatattcacgaggatccatttgtgatttttgggcgactaataatgctaaactgacatcatacaaagatagggcagatttataaaccacgttgacgtcttgcaaaaaacacaagtaagttacacaagagtctttttcttcagaattttctagttcactaattagttttagtgcagccgataagttttgagggttttgggatgcatatgctgtaatgatcgtttgcaagtatttcttcttgtattcaggattgcttaataaaacatttagcacagcatcgcatattttgttgactttagaggttttgggatcaaacattttctttttcatatatatttgcatttcagtcagtggtgctggttccattccaaatgacttcgagatacctgaataaagggtttccttatattttgttttggtaacgtcatcttccgacaaacaggaaataaataaattgagataatcaacccttccgatttggttgataaatacttctaagttttcaataaataactctggcgcatagtcatgcaaaatatcaaggttaattctgtgtgtacgacaaacaataaacgcctctttataacgttttgccatgatattctttcttacctctgccagtaccataattcttggataaattgtttctagattaccacgtgtggcttgcaaaacaacggaagacttagatggaataacggacactaaaatggaacctctttcaatggcacgcactctttcatcttccacaccctcctctaccaaaggcaatggcttgaaatcggtggaatttaaatgcacaaactgtaaattgtgttgtgccgtggtgaacaacagaaannnnnnnnnnnnnnnnnnnnnnnnnnnnnnnnnnnnnnaatcggtaatctccaaggaagtaactgccgaagccaaaagaacttgattagcaaataacttaccgttatttgtgataccaaatgcaactaactcagaactttctgcagaccagttgtcatcatcttctgctgatgtgttatggactctttttactctaaaatcacgtaccaattgaggaaacttggtaatttccattaactggccttccgcatccaattggcaaactgtaccatcgcgagtttcatacaccaagtggttataatcaaagtcacttcttagtaaaacgattttatcatagacctccacaatagttattaaagttggttgcgtaatatcctggatatccaaaagcgctattctagaaaggttatctgtgtcaagcaacacaccgacaatggaatcgttaataaatgcaacttgccttaaagagtcaacctcacttgtgaactcagatttggggaattcgcagactatacttggatgtttgccttttttcatttcttcgatacttgggacggctgcgaaaattagaacatctttgttgattgctgcatatatttcattcgaaaaactgcacgctacatccaatacatttcctggagtttcaaaatcacgatagtacattggaggagggacattagcaagagctagaggagtgatattcactgtccttccatcaacaacaagagaggtaccgttatcgaacggctctaatgtcggaccctgcgccatcttataagcgaaatcaacgatattgataaatccagcatcagaaaacatcaacgtgaagtccttttctgggtgccatttaacgtaggaaatgtcgctagcgtacaattcttgttttaaataccaatggtaattcttggacgtccacaactgaatgcggtttgccaatactacggctagtgcctctgagttactattccagcatacactttctaccttctcatctagaggtaatcttgtatcaaattcaccatgccttaaaccgttacgttcgaagaaaatcacatccactgaatcctcctcaccaaggtcggtttttctttgaatggacgcaatcaaagaaccttgtggtttccagcttaactggtgttccatcccagttactggctcagaagcactatccaattggccttcacgggaaaaaactctgaaagctcttctttttattgattttgtttcatcatcttcgtctggtacctcctctacagaagaaacagcaaaataatcacaatcccctctccaagaaattgtgatttcatgactgtccaatgcggttacatcaccagtatctaccatatagggcatggtcggatctcttaattggttacctaccaaacctgatgcctttaagctggctaatgcttctctttccatggcacgtgcacctttacctctgaattgtgtttcctttttaccccaaccaacggtgacgtgctttgaaatcttaagatcatctacctctaaatggtattccgatatgggttcgaacagtttacttagaactaccacgttacgatctttagtcaccatggccagcgtctcttcgtcataggaccactgcgcggctgcaattccgttgtctatagtacccataatttcaattaaagtttcagctgggtccaaactgacaggatcataagtggctgtaatgatatcaccttgttcaaagacaaagactaattggttaatatccgcaaaatgaacaaaagataataatttgtcgtcaaaagtctgaatgttgaatgaagccaacacattcctggaaccatccttcatgaattgttgcacttcaatagcaccaatatccgtagaaccgagtacacatgttatactgtcggataatgtatcaaataccgagtctaacaaagtgaaagataagtcatcttcatcgccttctgcagtagacgccgttggcttaaatttacccttattcaaggtaataagattacgcatatttgatcttagctcctgcctctttgacccactcttgtcatgttcaaccataagccattaggcatttgtactgtttcttgcctaggcatcgcttttcattactatggaaagaaaaaaaaatttgatcatcgtgttatacgtattagatcatgtgctctagccttgtcagcaatgcctctttcaattgaggaagttctgtattctgtagctcattgattctctgcatgtagtagtaattggccaggtccactacagtcactggttgatcattccctgaagattgcgcattttttgggattccgtttgcgaagatatctgtaaccattgttttgagccctctcagagatatgtcgcggcagtattgagggccatataattgcaccaacttgtgtgtcttgaactctactagtacgtcattatcaatgacgggatcttttaacagcgtttgcaaatcaaccgacttatctcgatgagctagagtttgttggcgctgcaaaactaattgcagcaacaataacacaacgtttgaggggcaatccatcgtacgaatcttgaagtcctatcagcagctaacgaagtagagaattaactgtaaatgcagaaacaaagcaggattacaccgtgatttgatgaaatagcacgttccctttgtttgtcttaaatcgcgtttccgcgatgctcgaaaaagaacacgagaggaaggttcatagagaagcagaaggaggaaccttttgatgctgctgtgcttatctgctcaggctacaacaggaactggaacatggaaaaatcgattgccaaaggtttaagcgacaaactatacgaaaaacggaaggctgccgccttggagttggaaaagttggtcaaacaatgcgttctagaaggggactatgatcgtattgacaagataatagacgaactatgcagagactatgcatacgctttgcatcagcccatggctagaaatgcaggattaatgggcttggctgccacagcaattgctttaggaataaacgatgttggccgttacttgaggaatattcttcctccagttctcgcatgttttggcgaccagaatgaccaagtaagattttatgcgtgtgagagtttgtacaatattgcaaagattgcgaagggtgaaatactggtctatttcaatgaaatatttgacgtactctgtaaaattagtgctgatacagaaaactcggtccgaggagcagctgaactattagatcggttgataaaagatattgttgctgaaagagcatccaattacataagcattgtaaataatggatcgcatggtttgcttccagccataaaaacggatccaatcagcggggatgtctaccaagaagaatatgagcaagataatcaattggcgttctctttaccaaaatttattcctttattaacagagagaatttacgccattaaccctgatacgcgtgtttttttagttgactggcttaaagtcttgctcaataccccaggactagagctcatatcgtatctaccatcatttcttggcgggttattcacgttcttgggcgattctcataaagatgtcagaacagttacacacacccttatggactcactacttcacgaagtcgaccgcatttcaaaattacaaactgaaattaaaatgaagagactggaaagactgaaaatgctggaagataaatacaataacagttctactccaacgaaaaaggccgatggtgcacttattgctgaaaagaagaaaactttaatgactgcattaggtgggttatccaaacctctgagtatggagactgatgataccaaattatctaatactaatgagacagatgatgaaagacacttgacaagccaggagcagctgctagatagcgaggcaactagccaagaacctcttcgcgatggcgaagaatatatacctggtcaagatatcaacctcaatttcccagaggttattaccgttcttgtgaacaatttggcatcatctgaggcagagattcaattgattgcattacactggattcaggttattttatccatttctccaaatgtgtttatccccttcctttcaaaaattctttctgtgcttttaaagctattgagcgattcggatccgcatattactgaaattgctcagctggtgaacggtcaattactctcattgtgcagctcatatgtgggaaaagagacagacgggaaaattgcatacgggccaatcgttaatagcttaactctacagtttttcgatagtaggattgatgccaagattgcctgcttggattggctcatcttaatttatcacaaggctccaaaccaaatcttgaaacataacgacagcatgttcctaactttgttgaagtcattatcaaatagagactcggtgctaatcgagaaagctttaagtctcttacagagtttatgttctgactcaaatgataattatttacgtcagtttcttcaagatttattaactttattcaagagagataccaaattggtgaaaactagagcaaactttatcatgagacagatatcttcccgtttatcaccagaacgtgtttataaagtaatttcttcgatattggacaattataacgacacaacgtttgtgaaaatgatgattcagattttaagtacaaacttaataacttcaccggagatgtcgtcgttaagaaacaaacttagaacttgtgaagacggtatgtttttcaatagtttattcaaatcttggtgtcccaaccccgtgtccgtgatatccttatgttttgtagcagaaaattatgagttagcttacacagtgttacaaacttacgcgaactacgagttgaagttaaatgatctagtgcagttggatattttgattcagttgttcgaatcacccgttttcacaaggatgcggttgcaacttttagaacaacagaaacatccgtttctgcataagtgtctatttggtatactgatgattataccacagtcaaaggcatttgaaacattgaaccgcagattgaatagtttgaacatatggacatcccaatcttatgtcatgaacaactatataagacaaagggagaatagtaacttttgtgattccaattctgatatctcgcaaaggtccgttagccaaagtaaactacatttccaggaactaattaatcattttaaggccgtttcagaagaagatgaatattcatcagatatgataaggcttgaccatggtgctaacaataaatcacttctgcttggaagttttttggacggtattgacgaagataaacaagaaattgtcacaccaatctcgcccatgaatgaagctattaacgaggagatggaatctcccaacgataatagttctgtcatattaaaagatagtggcagtctgccattcaaccgcaatgtatccgataaattaaaaaaataactacccattacctgattgaaagcatctttggttaagaaatggacctgacatgctacataaatagatacgtaaacagatatttaaccgagacacataagatgacctattgcaacaactcatccctgtaatgtgtttgaaagttaacccttttaatttcgcgacggatctgcgtattaatggcatttttctccaattgttgcattttcttcatacccttcttatattgcttctcggtaacaccactgaccatccttctatcagcagctgtaatcgttcttctgctttcgttagggtttggctgcgaaggtaaattttgtctatagtacctctggcccgcacgatgacctagcctagcgcctgttggcaaggtaagttctaaaccagattcatcaatggatacggtggtatagtttgcattaatgtcattttcggatgagaccaacgtgatatctacctccccgtcttcttcatcatttttggccccatagacagatgaaagcttggaagtaattgctctgtcattctgaagatttttgctaatagagtgatcatcgtaagtaaaatcgtaaaatggggcgaaaagctgacgctcctcctttgtttcatatggcagcctgcaatgacgcttagaagccatatgcgctcttatactttccaaaccggagccatgaaagttacaacacagacagttatgatcaataacaatcatttttattaaaaactctagtaaaccgtttagatcaatcaaatatgacctttcaggtatgaaaagaccatgctcgctaaacatatgtttgacatttctttccacttctttattgtctttcccgcaatatatacattccgtgatggtaatcttttcattttctttatcacttggcttatccgctatatctagttcctcatcactagtagcatactcataattagagtcactagtgaaaccgtattcagagacagtatcttcaccataatctgtattcgtgttttctgttcctactgtcaaattagataattgtgaagatattgatccagatggggacaccgatctattctgtttttctttagcaatatccctgtctttcctcttcaataagttcgtaccaacttttcttcctctctttgacttgatcggtttcttctgtttctgaggcaaagcgttactttggttcataacaggctttagaacagggaaaccaaactcatcaacctgattttcagcttgttccttttctgaaatttgcaatttctcagcaaactgttccgcaccaattggcggcaggttagcaattcttctctttaagttgtacctgtgccattcggtcttcatgtgatatctttgcaaatcactagtcttgaactgaataacacaacagttgcatgtaaagaaagtagagctcatctttcaaaatgtaaatcctgctgtttttaagctgctgtaacccaataatgataaggtgattgtaggatgaattgtacaactgtgttgccaccgtcttgtgactattgcatatgactaagtcgttttattctctttcgtgagtggcaattttgaagaaacgacccaaaaaaaaaggacagaattctacaacacctgtacctccaaaaaacccatttcttttctgtttttactgaattgtaattcgcgcttgtctattcgtcattctgaaaaatttcacgcaaaacaactgatgacagatcttgaccatagcatagcatgaaggtgcaggaacatgaggcaggagcaccctacggggcaccgcgaaaatagctgtgtgaaagtgctatgcgatacacatataattaatggttattagatgcgcgcatttaacattttccctaactcaagtaatagctgaaataccacgaacaaaagtgtaaattagggtatgtaccaagttctattcgaatttaaaggttatgaggtacaggaaggctgaaaaatgaaaacttcgagatgaaataatccacgtcgaaagtaatgctgaaaacacaaatagctctggattcaaatcataaggacatacagaagtgttgctgacaaatcgcttctttttgatattagaatttcattcaatgaacaacggattgaagagttgtcgtgtcgacaggattgtacattttaccaggactgaggaatgaattcaacggctttgccgaacaaatcacggcataacctgcagaataacataacaacatagcgcttattaccattgcgtatgctggctgaaacgaacctttcactgaattagctcatatcgcatggacggaataacaggtataaaaaatccacgagttatcaacctcattctctttaaaattggaatccaatcaaccgaattcatttgtactaacaacgtttcctattattgcagataaaatggctcacgaaaacgtctggttctctcacccaagaagatacggtaaaggctcccgtcaatgtcgtgtttgttcttcccacaccggtttgatcagaaagtacggcttaaacatctgtcgtcaatgtttcagagaaaaagctaacgacattggtttcaacaaattcagataagccatcataaataaacaatgacgaatatataaatactatatgtatacatatatcaaactgcctttgtactttttatggtcctatttctccccgaatctttagatcctatatgtgctcttgagtatcgttggaggattcgtcaactcgaggtacgagatatgctttgtctcttccttgtattcgcttgctgatattccgtaccctagatttcttactttcgaaatacattacccggatcaattccattattttcgcctttcaaaaaatttcccggttgtataaaaaggcaggacttcggcagtcaacaacaattttgagtatatttaccacatcttttctgatttttttaagagggtgaatcaaaaatttattttttacacggaaacgatgccacagttgactgaacctgtcttctaacagtagttaattgccagtatttcaaacaagatttgaaatacgagtttcccagaataatttatatggacaggataggaagtccgatttctgtgttgtctcaaacgaggcgatagaattgggatgtcgaagaaagtctacattactcatatatttacgtactgtctcttgcaggtaaaaagtcttgaagatcagtttcaatattgaaactaacaaatttagttcgtttctgtacttagtccgaggtatgtatgctaagattagaggatggtaaaaaaatcagctatgaaaatacatgtacgtacgttgtcgtgcaacacaaccccttcactttctatttcagtctgattcagaactattattcagcttaggaggcgcggaaatctcgaagtctttcattggttgacgaacgggagctacaaacagcgtcgacttgaatgctccgacatcttcgatcaactggccagttggatacttagcggtgtccaattcattttcattgagctctttgttttccacttgagatttcaaatgtagaatcaacttcgatgcgttctcgctcattatataattctcataaaaatctatcatttgctgctttgtaatgttagcaacgagcttagcctttttttgacgatgtgtgaaattgtaatcacctaagtaaattgctgccgtgtatctggcgctttcctcggccatattcttgaatttttgcaacagactgttgcataacgcctctttatgtttttcaaagtcctcttctggcatatccctcaaaacctggccaaaagtttcataaaaattgtttattctccattctagatatggcgtggtatgttctgactgaatcaagatcctaatgttcgctgtaccgtgattgttcaaactcgaactaaaaacaacatagcccaattgctcttttgttcttaaggtatcaaaacatggctcgtgaatcaattgcgcaaataatccgctgagggcagataggtcttctgaatagacatctagctgggtgacatgttgaatacatgagttaacattccgggagtctttcaaagcagtttcatatctgaaagttttgcctttaggaagtaagtaggatctcaaccggttgttagaaacctgcagattatgaatgttgtttggaatcaaagacttgatcagagaatccacctccaatgcttcttcatgttttatgtttccgtggattaaagtttcaaaataaacgccttcgtaaatggtgggtatgaagttgatcaactgttcaaaggtcaatttttcaaagacttgtaatttttctgcagttgaccaagaacgttcatttattatagcattgtagtaattcgacatttgtgaataaggaacttcatataaaaggtttttcaagtgacgtatggtcttatctttcaaaatctcaaaacgatccttcttaggttcgaatgaattaacgccttgtaaaaaccttgttaatagaatgatcaatttttcgttgaacccagacgcggtaatggcgaggccttgattagttttattgaatgatatacgaagatcggcacaagcagcatcatattgtagatctttcaaggcatcgttggccagctgagtgtatagcgtagaaagcatactattaatgatgcttgcatgcgtatgtggaagtttaaaagacaagtaaatgtagcctcgtggttgccagaatcggtcgtccttcttgtaccataatttgctgacgtcatcggataataacaaaacaggttcatctaatggttttataccgtcaattttatcaaccttgaaatttgttgaaacgaattcatttggacgtggcaaagtcagagcagggttcaaacctggcgatttcatgttttttattaaatctgccggataatctaccactttatacgcagtaccataccatttttcagcagaatctgtttctaaacttcttgagatcaaagtaacacgagaattttccgggaccagagcgtccgtatattgggtaagcaaatcaggttcatatttcgttaacaaacccatggctaaaattctgctaacaggaatgtaatccttttccaagcattttgccaatgatgaaactgtggaagatgggctaccagcttgcttaaacttgaaggtagcattagagatatcttgcagttcattgaatatccatttttgaggtagtgagtttttcaacatttcaatatactggaagatcaagacaataacatcgcgataatgtgtcaacccgttgtctgttaaatctatatcgacagcaaaaaaagcatttcctttggacacagtatgcccaccagcagatagctcattggcccagcccaattttttcaaatgtgctagtaatgaaccggacccttcatggccgattaaatgacttaatatcctcggtggcttggactcccaatgttcctccatatcagggacagtgaaagagatttctaattttttcaaatctttcacaggacggacttgaattattttttgcaaatgctcaggctgcataataggttccgcataaaggggtacttcacgaccgttattggctacatccttgaagagatcataagtccaattagagagagtatcaaggtcttctctaccaagaatacatagcttcattagattagcggagtaaaaattcttatggaattttaacagttcatctctaacatttagcccattttcctttggcaatgtgcccaaagtttcgatgtttcctgtagaaaatttgtgatatggatgttttgtattggtcaaagacttgtctaattggtaaattctccaaatatcattctgtaagttctttttgttttcgctgttaacggcgttgatctctttatcagtagagtccttgttgaaaagaggacaagagaaaaaccctgaaaacctgtctagcgcaccaaataaatgttggtgattaacctcaaaaaaataatttgtgttttgcgatgctgtgtaggcattggatgaaccaccgtgcttgcttaaatagctcgagtattcgttttcgtctggaaatttctcagagcccatgaataaaagatgctcgcagaaatgcgccaatccaggtaggttctctggatcttcaaaggcgccaatattgacgtctagcgacgctgctgctttatctgcttttgggtcctggatcaacagagccttcagcttattaggtagctcaataaaccgatacgatctttcgtctaaatccggctttaaaaagtctagattgaatgtcttaaaattggatgtcatattataaggatttgttgtgtaatagcgtgataagcacgtgaatggcttgaagcgtcttacggtgaaattgagactgataggtgagaagtgaaccaattgagtgaggagtggtttagttacaaatgcagaagaagaagctaaaagagatacgcccatacagagcaatatcaaaatgagcaagaatgaggtcttccgaatggttggttctgatttactatttgatttcactttctctgattcattcaggaagaaaaggacgaagtcctcgaaatgaaaatttcaacatcattaacagaccggcgcgcgcctttacaatttagtatgtacgccaccaataaaagctgcctaaacaataagctagaaagcccaaagggtgttaatagtacagcgaacccttcagcaacggtacatcaataaccccttgaaaagaatagagacaataaagctacagtcatccccttctcttgtatttttggccacaattgattgtattacatcatattttgcctgtgcgcttcttctatcttttccgcataaactaggggaaacgcgatgaagaaatggattggctgaaaaatacaacaattgtagtgttattcagtcattcaactgacaaaagtaacaaacacaagaaacgtcaagtccagtgcaatatgcgaaagaacaccttagatatggtcactataggtatcgcatgccttgtgggagtctacacgggcacgagatttttcgagcccattgttatcgatagattgcgtaaggatggaaacttgagaacggacattcccatcccagaatacgacgaggacggaaatctgttaaaggtcacgccgtctttatcatccacaccagctgcaccacctacaccacctacacctcctgctccaccacaacagtaaggaagcgtactagaaaatacctctatactttcttttcctgtatatagcatcaatagtaaagccattataacgttacaaaaacctattacccggaaaattactatttatagaagcattggacccatgcaccacatgcattaggacccattatttcttttttacaatttttccgttaatttttcacgaatttttcaccgtttataaacactctcgaacttataaacaaagggatgataaatagatttcgccagttgttaatacacacagagtcaaagctcacagcactactacactcgttcaacactcgttatatataatcatgcgtgccaccactttattatcttcagtcgtttctttggcattgttgtcgaaggaagtcttagcaacacctccagcttgtttattggcctgtgttgcgcaagtcggcaaatcctcttccacatgtgactctttgaatcaagtcacctgttactgtgaacacgaaaactccgccgtcaagaaatgtctagactccatctgcccaaacaatgacgctgatgctgcttattctgccttcaagagttcttgttccgaacaaaatgcttcattgggcgattccagcagcagtgcctcctcatccgcttcttcatccagcaaggcctcttcttctaccaaggcttcttccagtagcgcttcctcctctaccaaggcttcttccagtagcgcttcctcctctactaaagcttcttccagcagcgctgccccatcttctagcaaggcttcttccaccgaatcctcttcttcctcttcttcttccaccaaggctccttccagtgaagaatcctcttccacttacgtctcttcgagcaagcaagcttcctccactagcgaggctcactcttccagtgctgcctcttcgaccgtgtcccaagaaacagtctcctctgctctaccaacttctaccgccgttatttctactttctctgaaggttctggtaatgttctagaggcaggaaaatccgttttcattgctgctgttgccgctatgttaatctaattatctatcactttatttctaatgggttaaggtatctatcttttatatttcttatttcctcttcttatatgatgcggatgattttatttcttcaaaaaacattttaaaactcctctttatttcgttatgttccagttcactacgacttcttttctcttaaagagcaaataaaagtatataaatctatattaaatgaaaatcaaaaaaatattttttcgatcagctccttgttcttttcatttcaaagttttttacgttgttacacatgtgcatgaatatatatgtttgcagaatatttttggcgacgcttaactcgccatttcagtatatgtcggtggcggtacatatctgggcagagcttcagcttcaacgtgctctctaacttgacaaaagatctgaacaggatcaatgtttacttcagattgcttcctaattccattgattccccattctatcagtagctgtaaactgaatattctttttatcgtgcatgtcttgaaactatacaacctattgccgcgatgtctatagtcttcttcattaaataccaactttcttaaaatgggatgatcctttaaccgtaattcacattcaaacatagaaccatcaaaattttctcgtatttcgtttaagtccaaaagaggtttattggatttgagctgattcaaatcaatctcgattagcttcaaagaagagtaattgccgttcgctattccctgagataaatatgttgtagtctctagcaagttcagttgtagtttaagtggggtaatttgcattttgctcaaacttgctatattcccctccatgactacatagaccttgtcaaaattttggctgccagacctaaacaagtagtctttcctgtatatttgcttcaaatctcgacttctaacctctattctcatattgctttccccatcaggcaaccccattttataagtagatgggaaaactttcataccatttactaggcgagtagattgtcttgttgatgtgactgatgataccggtctcgatctaatgtcgccgttttctatcaatatagaattagcttgagaaaagtttctgtcactttttatatatccgactccattaacgactttgacgtcctttgatggcacctttaaatttgaactattgaaaaattcattgttggtgaccaaactatttcctctcctattgttactgaaggcattaagttcttcattgtcatcttcatcaggttctacaataagatcttttggctcgggtataaattcgaacgtctcgatttcccttatcagtttatggaatggcttaaaccaagatgaagatttccctagctctatttgaacttgcaccatatatataacttttccaaaagagtaaaaatacaaatccagattatcgattttattaaattcttgccaatgactattgaacgtaggtgggagtcgggcattacttcttgtcacaaacgctactgtctttgccgtatgatttttcagacattcaggctttctgggaaacttgtcaaattgaaagctataattatatgaacctggtttaactttgaacggcttggaggagccatcaagagcattccatacattatctggagggaaaactctctgttcgaatttcattaatgtatgaaaggatttgttgtcttggcccggcatcatcatgccattctgttgaaacatgtactcttgatcaatttttgttaaggtctctgagaatccttttagaatgacggaaattttccttatagatagcgcttttgttaactgaagactaactatccctgacatttgatcattagagctataaaactccccgttgtacggtgggtttaaggatattgaaatttttggagccatggtttgacaaactgtatggttctcaaccttttctaatcaaaagcagaatcttaaatataaacactcacagaatatccgttggtcaatgaagtaatcctcctttgtactggctgctttttctcctccagtttatgtaattctacttttggatgggtgcgactgcttttaattgattgagtggcggtgttagaagggctgtagagtcgaaggcttgtttctctcttacgcacctcttgtgaaaagggcgtgcaccttccccaggaccctctctcaccctcaacccgcattttgctgagaattttcaccaaggccctaggtgatattatattccacctgactaattgcattacagcggacccaaggcaatatcagtttaataaaatatcatgtatctcaccctcttcttggtattagtaaagagacgcctgatcttgtaacagtggtgaagattgtactagagcagaatcaagaatttaaaaagtgtaaaggcaaggcagaggcgatgtacataaaacttcgaagtaagaaatatttaatagttctcgccacatcactatgcagctatacaaaaactactataaacgtttgttttgttccttacgcacaatatccttgcctagaaatcgtttttgaaatttaaatttttattaccatttatttgattcgccttcagaaaaatatgaaagagtgcatatttaaaaaggactatttcagcatatagtaaaagtcaggttatttgtttatttgcgatatcagagtaacttaaactagctatgcagggcacttttaaaaggttttaccatcccacgcttacgcggatgtccttcttggataaattcctcaagcctatgatggcaacggcttccccaaaggaataccagatcaaacaactggtcaagccaataggcttaacacaagcaccaaggaaaagcaccaaatactcccaggggaactctttgagggatatgtttgattcggaaaagacaaaccacagagttaaagagttggccgttgaattcagcaaatctggactttatgacgtgcaagtcttccaaaagacaaaggggaaattgtttatagctccagtttcatattggaaagaagataaagctttgttttttcctcatttgataggaacggcaatggatggtacgaaacaacagaatatcgaggatatgttaaggggtaaaaccagtatagtgaggttatttagtacagcatctggcgataagttgagtagttcatacttccaaggaatcgtagacgataacaaaaaaactgactacttgactgaagctgatgcgcgtttaagtttaaatgacagtaacgtccaaatcatcgaggtcaatcttgtagaaaacgctgtgaaaagtgctctagtgaaaacgcttgctcgttgggccaatcgcgttccatcctggcgccagccattttatttcgaatgttctagaggccaatggccattttccgtcagggaagagctcttttgcaataatgtcttttctggatacgtctttcttgtggaccagcagttaaaaattaggtgggcagcttgcggggaggctactccatctgaaaaggaagcattgtggaagtttgccaaacgtctgtgaagttgacgctttgtgcggcggccaacaagggatgggcggctatttggcgatcgtgttcattccccaaactaacacgaagagcatgagagagaaaaaacaaaagtgcttaaaacaggtaagacgtttatcattgatatcaccaaagaaatatataatgccggattctatttttgaacagccctttgtttactgtggtgtttgccacagaagaacatcgcatggagatccattgaggctgacctcatgtgctcatatcctctgttcgcagcattctccattaacatcaaaggtgtgtcctatatgccgttcgagcgatatctccatcattaaccttgtggaatctaaacagctgcctaccgacattaggattttttttgagccactgcccccacttttggagtcgttatataatgtttcccaattccaactgaatgggctttcgaaacagtgtcaatactatcaaaatcattgtttaaagttgagagaaaagtgtgcaagacaacagcagctgctatatcaggccaaaatagagttggattctatggcgattcttaagaaaagaatacaggaattagagtcagttttgaatcataacaatgtttcttcgatgtcagttggtgtgctaccaacaagaaatagccatcaaaatcattaccagccccctccaaccgttgatctgacagttgatgataatagtttagaagaattcgaagccaaatcctttattaaaaagttgaaaaaaaactcttctttgagaaattcttcaaaaaataacaatggaactgtcactccctctacaagtggtcgtgtaaataaaaaccagcctctctttatggagacattgaataatcctaatagaaatagcattcctcctcctggaatgaacccaaacgcaaatagtaatctacctaatattttgactattgcagaatcaaccaatctgaacagattttcgttctctcctgtgcgtgttgcaaaaggcttcgatggaaagttgccaaatcttgacattctcacaaataatggctctgtatcttccaaaaatatatcaagattatcttcagcttctctccaaccctcttcgcctctatcttcatcatcaaataggcttattttaccaaatagtaacctcaaagaattgcatcattcaaatacacctttaacaagtacctcgacgcagtttccctcagctttagaaaaattaaaaataacaaggaagagaaataatactatcagcggttcgaatagaataacacacaacttgagctcacacgtaagaagcagtggtcttgccttttcatcttcatcgaactcattgcaacaaagtaaactgccgaaatcaaatatactaaagcggtccaattcaactcagcaactgactaatacacatttgaagagtgataatcatctgccacctcgctcaagtaatactgtgttgggtagtagcaagaaaaacaataagtttagaaggattaggtaaataggtgtaaggattccccgtgacgaaaacagccttcagaatagatagagtatgttactgtattataaaagttattctattttcttatgtgttactatatatggtattattttagaagaaatttgtcgaattatgttcttcttagatccttctttcccgccgtctcaatacgaaggcacaaggagaggattatgaatatatgaaaagaaaattgtacaaataaataaaacgatgatatgcgcacctaggaatagcaaagaacacactctaaaacgtctcaaccaagcacgctatgtacacacatctatccttcaaacttatgggggtgttttaaaaagcacctgactttttcaattgaacatagcaggcaacaaatggaacagcaaatccaatagcgaagaacccgaaatgagataaggcgtaaggtgtctttcttcctttgactttgaatgggatattttcatacacaccgtctttgaagtgtactgacctcttcatgataataggtctggtcatgatattgctacttctcttagctgtcgttctaatcatctgttggcacaacattgcgtaatggaaatggataacttttctgtttagtttgctctgtggctctatctagaaaattaaaggatacaaaactaattaaccattcttataaatcactaagccagcacaatggtttctactgctgtcagcctttattttcaatttttcttagtcccctagcttttccgtaaacaccgaacacttctctcgtatgattggtgcaaaccgtttggtgaaaaaaagcacatttgcatatacaaaaaattaacaaatctatcatataataattaagatatagagttcatgatccttgtgccattgatcaagccatcggcgatgatgataaaccttttattgataccttttttacctagtattttttgcaaatgcttcattatagctatttcacccattgttacacctccgaggaatactacgagtgcaatatcctctgcagcatgaaatgtcccattagatccgtctatggaccgtctattattgctcttgatgcttgcattgatcttttttgtaatggttcccgggacccatatactctcttcgatcgcatgtgagtctccatataactgttcaattaaatcctccgtttgagaaactctaggttctcttgacagtataaaaggctgctgcgaggaataattatggaacaagatagacctatcatataacatctgaaccagtctcattgtcaagggcactacaccactgtaagcaaaagtggcttccgagaagtcatcgttctcatttgtgattttatcggcagcatgctcgtcttctatgggtactgtattgaaccattgtgaaatataacggtattctttctgtaatcttgttgacttacttgttgtaatatgcaaatcagtttttcccgttttgctagtgaaaaatcctaactcagccaatgattcaagttgaaagcatttttcaatgccccaagagtcgatcataaaggttcttagatattcataatccttttctcgaagtgaatttttacaaagagacaataaacagattaatctgagaatcttcttttgatcaacctcgtactggtactgcaactcgagtataatatcttcaatgtcgttattaagtgtatttcccatcaaaatttccagctctaactctaagattttattgaaagatccgtactcttcagtctctaccactttcaaaacgtcggatgataaggttgtgtgatttttcaaaaaagcttgcctttgttgcaaagaacctaaggaatcaacgaattctttgatttcatgtacgctctcggctttatgccttgtatcatattgcgtttgtagttcctttgccaatttatttaactgcggcccaatcgacccaaaatttaaaaatttcaaatcattccatattttatcttccttataattgaagttcatgtctttctcctttatctttatgccagaattgaattcatatagatcatctagtattcctgcatacgtaagttgtgtcaacaatggcgttataggatcggtattcctttccaagataatcaagtccatttctagtccacagttggttcgttcaccataaagcgtacccttgatgaataaatcattctctgtttgatgctcatcgattcgtttcttcaaaagatggctacatctcttagacagattacctatcgacacaacatttgttatgatactattagtttcaaaaatcaagctctgcaacgaattgaccatatcatcaaccagtattgactctgtggcactctgcaaagaacgtaagttgggataatacatgtttacattttccatgttataaagggaatgagtcaatagaacattttcatcaatctgtgggaagggcaagagatcccaagggtaaagggtatattcgttcgatagctcctttaactgagattcaatgacgttagggaaatgtgttttttttgaattcaaatcgaaaccatccttttgccattgctctgtatcctccaaagtattttggaaagacggtttccatcgacagtatattatatgcaaagatgataaattgtgcttttgagcagcatcaagcagttgtggagggagtcggagagatgttctgacatcaataagaaaaataagatccatttgcggaacgctgcctaaggcactcggtaaatcgtcacttagctgatcatcgagtaacgtaattttccttacaggagttgattgagtcaaatcttggaaagttagcaaactattgagtactggcaatacacttggttgaaccacaagaacttcatcattttgagatatctcatttaaggtagcacatagtccatcggcatttgttaatgaaaatttcttagtattccaaaatctattcatcgtgaaatgatttgataaagttggagatgggcaatatcagctttttcttcctttctcgaattttctatcttttaactaattaacatataactagttccaatttgctaacctttatgatattttatttatgtatgttcgtgtgaagtgattaatatattatacaaaatgaccggagttcagtataatttctatctactattattgagcacacaaaggaaaagaattgactatgaacaagcttacgaagatgaaccgcttcttagagcaaactcttcataataagagagcatttctggagtaatgcccctagcaattcctttaaaagctttctcaaaatgacgtaattccacttttgcgacatctaaatcttccattatggcagccaagcccgcttcttgacaaagcagcacaacttcagctccggaataaccttctgtacggtctgccaattcatgaagatcgactccagactcttctgtattaaatttctttgtgcacttctttaagatttccaagcgggcgtttacgtctggagggccaacgtaaatgtgtctatctaacctaccaggccttagaagagcagcatctatttcatcaggtctattcgtcgccgctacaataactacaccctttaactcttcaacaccatcaatctcattgagtaaagatgtgagcacgtgattagctgcagaggtggaactcccgtctctatcaggagataatgcatcgatttcatcaaagaagataatacttggagctgcagagcgtgctttgcggaaaatttctcttatagctctttcggattcccctacatacttgttaaaaatttcaggccctttcacagctaagaagttgatacccgattctgtagcgagagcttttgcggttaatgtcttggagcaacctggcggcccgtaaagtaatacaccttttggtgcagaaattcccagcctggcaaaagtctccgaagcctccaaaggcaactgtatcatttctttcatctttgttttaagctcttcttggccgccaatgtcagaccaataaacttttggcatttctaagaagatttctctcattgcgctgggtctgatatcaaccatggcgctctccacatctttcaatgtaacttttagggaaaacttgtcaatattggcgtctgttcctagtcctcgttgtatcgtcttcataactgattctctgcagagagcagttaaatcagcaccaacatagccatgcgttttagaagcaatgtacttgatcgcttcagaatctaatacgtgacgatccgaggacattcttgagaattgcttagttaaaatgtcaaatctggcatcaacgtctggtataccaatttctacttcttggtcaaacctgccaggtctcctgagagcagggtcgacagaattaggcctgtttgtagcagcaattaccaccactttacctgcagcgcccatgccatccattagggtaagcaatgtagccacgactctgctctcaacttcaccggagtcatcgtttgctctatttggtgctattgaatcaatttcgtcaatgaaaataatggaaggctggtacttccttgcttcattaaaaatatctcttaatgccgcttccgtttcaccaagatatttggagacgattgaggggccattaatggttaggacgtgtgcgttggacgtatttgctacaactctcaaaagcatagttttaccagtacctgggggtccgtgaagaagtatacctcgagggggagaaacaccaaagctactaaatagcgtcggttgatgaagaggtatttcaatagcacttttcagtgattcaatctccttgtctaagccgcccactgctgcataggataagggctccggaagattgtatttacgatttgcctgggtttctttcgaaaaagttatatgtgtggagccttttctgaatataaaaggtggagatagataaaacaggttatctaatccaccgtacatatcgtccatgttaagatctagttggctgacgtcgggaagcgaatcatcgctcgcatctgtaattacgacatcaatgctttcatcacctgcttttgtttttaagttttgaaaaatcattccaggcattataacgccactatcatccagtagcttttgaattactttttcctccatacattccaaaatattatatccttgtaaggaccccacggtaaccttagtggcataaggtggttgcacctgggctttctttaattctagacgatcaccaaggataaggttcccaacagatcgtatagttgtggaaagggtgataacattaacaggatgtacttcttcatcacccgctctagctattactaaaataccattttcgcctatcttaccgacagtacaaaatgatcccggatttatctcaagcgaggataatacgttaggatgaatatatgctgtgcatgtttccttgccatgatctttagaaggatgtggtctggtaataaattcagcaggcaatttaaatttggatgcttttgcatcagcactattagaacttgccgatgatttctttttggaaccggaagaactagatttaggagccattttcctttctatgattgggcaattttgagaatgggcaatgttgagaattcaattgtatattgttcgcatattagtttatgtgatgaggcaatataaaattttcttacaatagtccgcccgttgcttacatgaaagaaaaaaaaaataaagatggatcgaagtggacttaaaaactatgtatacgtgtgtgtgtgtgtgtgcaataagagttcgaaaacattaacttttataaacatgactcacattgagaataaatgagctctctataaatacaaacttgcggcgaaaacaatatctctcttaatcaactcttgagccctgctcatcttcatatgtaatgtggaattaccaataataatagaggcagtcttaacttcgcggcaaatttcgtctagccaagtgataactctgactacagtaccttcagcctcggggctcatttccatgatttctttgaatgataaaccacgggcccactcatacaccacattcatcatggcaaacctttttctgtccaaaaactcagcttcatcctgagttaatggaatctgatgcgtattgaaaacacaaagcattttcttgtaaatttcctcaattctttgtttaccctttgctagccttggtgtgacaataggaggctcctcttccctggttttcccctcataaacaaatactgataataaggctacaatctcttcaggttcaaagcttcctaaaaagttgtctaaaattaattcagttaaaactaactcataaccagaattaatttcacatgccactctaccttttaacagcacgttgtggttttggtcgataaattcagtgtctttcagaacagccaatctcttttcataatcgggtagtaagctcagattttggtcagacatcaaatggtacaattcttcaattttctttttaattacatgcgccttaaacttgggaacaatgtgttggcttaggttgggacatttaatgctttttagtttgaatatctcatcccttatatttgtacggtctaacaatatttggtgaatttttaaaccttgcttttcaatgttaattgcttcttttagcgttttgccgtccaaaatgttatttgtttcagcgttaaactcgttcaaagcggcaacatcctttttaatcacttttcccaagggtgcggcaaacttgcgtttagtgatcacttcaatagccgtcacaggaacttcttccatataaaaatcagtcttctggaatttagggaagttccttcttctgtatccatccgcttttggaaagtatattaaatgatttggctcaccatttgggagtttgtatggttttgtgaacgtcataatgacacaaacagcatccttcagagaaactttaaatacaaatcctaatttcaagcaatcattggggtccctaaaagcaacgagtctgccctctttcaagatatgcaatatcgaaggcgatttaaccatttcttgcattaggttgactgttgcctccttatatgccagcatcaattccaaaaacttttcgatatcattatcacagatttcacaacttttgtactctatggtttgtaattcctcttgtaatactttgatttgtttttcatgttcaggttgtaaagtttctttggcattctcactaaaagaatacttgatcatttcttcaactctcaacgcctcaattcttaaaagatttaatatcatattgtatgttaatctaaactgagactgcaacctcgtcggaacacccatcgttacttctttgaacgtagcaatagataaaggactattatatgccatcacaatgactgtaccagtggaatccaagccccttctaccagctctaccagccatttgggtaaactcacctggagtcagttctcttaatccattaccatcatgtttacggatgctgctaaagataactgttcttgtgggaaggttcaaacccatggcaaaagtttctgttgcaaataaaactttgataaaacccttggaaaataatatttcgatcaactccttgacaatgggcaatagccccccatgatgaacagctataccacgttcaagtaatgatctggttttaagaatttgaggcaaatctctatcctcttttttcaaacgagtaatcgacttctcaataaacatgtggatttgtgatttttccttattgttgcagaagttaattccctccaaccagtcagcatattcctcgcacctctttttactaaatacgaaaacaaccattggtagaagctctcttttccttaggtaattgacaatttcgggccatgtttttttcgaaggaccatcttgagtgaaaaacttacgcttgttggagccaattgcgccagcacctcttgaacctccacggttggcacctccacgtgttgaattaccacggcctcctcttccatctcgagtattggatccaccacggccccctcttgctgtggatccacctctcccgttgtcagtttttgaaggagccccttttgcactctccccatttagaatctctttatgtttcctgaaattagcttctaaaaattctgaattttgattaataaccggtatcagttcctttttagcccatatatttatttccaatggaacgggtctttttggtgtggaaatgacataaatatttttttgcttagttcttccaatccaattagcaaactcataagtgttaggaacggtggcagataataagataaacttgacatgctgtggaagcataataataacttcttcccagacaacaccacggtcttgatcattaacgtagtgaacttcatcgaaaatgacaaactctacatctctgatcaaatcggcacctctataaagcattgatcttaaaatttcggtcgtcataatcaaacagttagcatccggattaatttgcacatcaccagtaatcaacccaatattaacatcgtcaaaagtttctttaaagtctcggaatttttgattggataaggctttaatgggtgatgtatatatagttttagtcatgtttctatgtgccatggcaattgcgtattctgcaacaacagttttaccagcagatgtgtgggcggcaacaaatacggaatcaccttgttcgagatgatagacggcttccttttgaaatgtatccaattcaaaaggccacgatctagcggggtttggaatcaactcatcgaaattttcgatcttatggttcaaatcaacaacatgggcccattcctttttaacaggaacacttttcgaaactggtttagttctgccaaagtctattccaattggtaatagttcatcgatttcggcatcatcagcattatcggcagtcgtttcttcagtggcttcctccataatttcttcagaaattgacttggcagatttttcctcctcttttaactttgcctcgttcgcctcaatccttatgtctaattcattatctatctcatttagctgtttcaattctttgaactgtccgttttgatcctcattttcagctggagaatccatcggcttaatgcctctattcataccctctggaatatcgaataaaccttgaccatccttgtgtaacaatttagtagcgttggccattgtagaagatccattttgttctgaatctgtcttgacagatttcatgggaattccgcctggtgtgaaaggcaattgcgctgtagaaccccttactgagttttggttatggttgatacttctcgtaatcgacagtgaatttgatgcattggcatttgcaacttccttcaaatcaacctcttctttgtagcctgaaattttaccttctaacccagttcttttaaactggtatgatgttctattaattgggtccgggactttcagcaattccttgtaatctagtttaccagagcaatcttctggagaagacgtatgtggaacgtcttggaccatgtccaacaagctccaaggaagagcattagaaggtctcaaaaatctatcctttatgatatcatttgcatgctttggttcatcggtgctctcaaaatctaatttagtaatgcgatcttcgaaaagctctacgtctgcgttgttagtgatttcttttaacgattgatataattcctgtatggaactgctactgaatccctcagacatataaattagtattagtacagtaaattttgtgagttaggttgttcatatcggaaagaactatgtggcaatgtattatagtttctgcgttgacttttaaattgatgaacaggttaggttgtctttcaatacttcgtccgtcgtgatatcattaactaaagttatgccatccgatgggcgttctgagacaagaggaaatttttattctaattattcattattatatagattatgaattgatctatatgatgagatcatgtgcaaatgattaaccttgttaggtttatgtttttttttgttttaaatttgtgagctttataatgttacaaccgatatgaaaatgaaaaattacctgttattcctttttcaaacctctatccgttcctaagatcttttctatctttattttttttccttccctttttgtatatgagcttaagattaccacttaattaatcaaaatatcaaaatggtgctcattcttctcagtcgttgaagataatcaaattcaaaattcagtcactcttcttcactttcgctgctaacatcgtcatctgaagatgaggaaaacccgttgtgtgcagcgctttgaatttggcctggggagccgttttggctcagaggtgaagcactgtctaagatagctagtttattttttatcttttctatctgcctactctgctcctcttggcttaatgccttagatcttctctttctgcttcccgcacttgtaggcgacaaggacgaagcatctcgcgtaacacctgaagtaccgtccaaaccgttagaagcaccggatgagctttcatattgtctaaagaaagtgttgtacaatgttaagatggtgtgattatctaaagtgtcgaggtcaagttctacttcatcgtcttcagaaatattgggcatggatttttttattatgtcgattgctctttctaatttggaagttggtaaatcattgatcctctctgtaatgatacgtttcatatcatatgtcactactgttttcaatttattctttttatctcgccttcctttcgaagaagcgttcttagacccactccttcccttcgatcttttgccgcgtttctttgatccacgtgctaagcgcctctcttttcttattttttccagttcttgcttttttaattgttgcaactccactttcatccgagcaagttgttcttccaaatactggatggctggatttgtaattatagtttcatcgatgtcagactctgaatactcagattcataatcgtcgtagtcgccttgggtcctcgaatcttcatcggaatcgtagtcatccaaattaggcctatccgcccatttggaattgaaaacttcctctagacgatgacccatcatattaacgatcgtgccatccggattgaacgtgtagcagtttttaaagaccaacctcacgtctctctcaaaatcctccattgtttgatactgccagtcatttaatttcttggcgattgtgcctaaatccattggctctttaacataatcgaaataagtcggcaaattcatagaaactgggtctactggttccaaaaatgggtagttataagaggcgtgcttcttggccatcaattcctttagcacactctgacaaaatttcattgcttgttgtagtcttttggatttcggtttcttcgattcataaggataaatatcctttgatttcggcggatgtatagtccttttcggcctcccattatgagtttgggctcgtctaattacaattggggcatcctcttgggcactagaccgccgtcccttggctattacaggtggagcatccttagcaggcatatttagcatatgtttctcgaaagaagcttgtatgtttcttgccatttgtgatatgcccgcatttggaccgttgaatttaatactgttgttaaccatgagattgaaatcctccgtgatttgctccggaacttcataagcgcctacgttcaacttcctctctatagtagacaagtccattggcctctttatgtagttaaagtaaaagggaatatccaatttcactgggtcaacaggttgtagaaagggtctcgcatccttcaagcgtttgacagctttaatcgcaagcaatgcatgtttctgctggtgctttggtattggattctgagggagattattcatatcgggctctggaggaggagcaggggcaggttcctttggaacctccatcggaagttcttgttttgagttttcatctaaatcctcttgtttggtaccttgtcctccttcttccttcttcaacccctgctgttcgtcttctgcgccacttccggtggcgttatacccattttccccgttagccgccagggtggcgccttcaataccgttctctgcaagtccagcaggcgatgatgttagagcatctccatccagtctagcctttttgagatgcaactggttattggcggggttttcttcttctgcgagtccattcgaaggatccccttgatctataggcctctttagattactggaaacgtcgtcattgacattattaccattgacatccacatcgttctgtacgggtgtgatatcggtcattacgtacgtttatcagagccgttgagattcgaccgccttttagcttgtttactgtggcaagggagaaaaaatcaaattatttgggaaggagcgacccagtaggcttaattaagggacaagaaaaacccgctttgtttaaatacttcgcgacgacgcgcgacaagcgacgacggccgacgttgtgagttcacggagcaagcctgaagttgctgcacacacaaagtgcgcggggctactacagcgggggcacgggtgcatacatcttcaagaagaaaaaggtgctgggtaatacaaacacgaatcgacgtaaaacgttattgtacttcctttccgcggctaatagcaactgcagcgtaggaataaatatgccaaaagtgtaaatccaagcgcctgatacaaagtagatgttgaattgttttaaaagacttactcaagtaccaggaaggagctatgtgaacgggatgtaatgaactttccagacaccccagtttgcgaaatgccttttttcagaggcgacttgcgagattcaaatcactgcgcgttttctaaatccacctgtatttacctgctatttgagccactcaggtacagttgcatcaggttgatagttatgttcatttgtgttgcgatgataacctgtccgaactcgttaagattttctcaatacacttttctccgctcctacctaacccttcccagctgtgcttattttgattttcttggaacccatacctcacgtttgaaattgacacccgtacatattccaattctcgtcttgcaaaggaaaaataaccgcgcttacccatcagatatgatttatgatacatgtacacttgattttctatttaggaatctctgtttgcataagagctgctcttatgtttggggacaaatacaaagttctcgtcggttttaccgaaaaatagatcacttagcttgatccaatcattaacatccgtactacccattagagtttcaagttcgtctcttccacaccagtttggcggtctctcattcaacttcacagggtatctttcacaaatacccatggggacatacctatgaaaaaaggacatgaactcgcagaagaatctacgacattgagaaatgccgtattcgtcggtgccccagtgttccatagagaactgcgcataatcccttaaaatgtctaatctttccgtacttgtcttgtctagatactgctgcgactcaacctcttcaaaaatccatggtttgatcagggcccctcgagcaaccataacactatcaatattttcatttccgttcaaatagcggtaccagtcttcaaaattgttgacatcaccatttccgacaaattgaattctgttcttggaatccctgccttctttgccttgttcggtttcgatgaaatccgcttcggcggatctcaaggtgtcagccacttgactcacgtagtcccaatccgcagacttagtgtacctttgttgcctagacctaccgtgtaaggtaatcgcagccacatcagtttcgttaaccagtcttttgactaacccttccgcgataggatgaccttcctttgtacctgttctgatcttcaccgtgataggaatatctttcgatacgtagttcatcgcgtttaaacaacgaatcattcttgcagggttatccagcagggcgctaccagaaccttgtctgtatagcaaatcgatggggcagccagagtttaagttgatttcacttatttcactgacggagtttgcgagtgcttctgcagcctttgccgcctgccaggctttagaacaggccacttgaaccccgaacccggggaactctgatgtgtgagctttaggtaacgcccactcagaattagttccttgaattaagggaactgccaaggccatttccgaatatgtcacatctgcacctaactttctcattagacgacggtatggtaaattgcctacggttgtcaatggcgacacgatttttttgtggtacaaatccagtggctttttttcttgagcaaaataacgagtgtccttgtacttcaagtatacttcacgctgtttcattctatgttctgacaattctttgttcctctgttcgacttggggggcaactggttgttccacatctgggtcttgtttcttcagctgtggcgttgactcaacttcttcttctggcttcatggaatctctacattcttgttggaaagagtcgatgatttccaatatttcattactttttgtgaaaggaaatcttctttttataagatcgagttttctttccggtgagatatggtttacctcacctttaacggaccatattgtttgcgcatctggatcaatctccttcttcgatattaggatattatcttctttattcagatgagacgataaaaatctgcatttgaatcccatggggcaaaatcccaacgagttgaagaccggacaggaaggaaatatattactttcaacttcaggcttttttgttgaaaggtacagattgatatcgtgaacaaacctacagttatcaccaaaggagcatttagatatatcgccatggatcaagcgtgggcacaagacattctgttccttgacctgcctgttatctctattcttgttttgcccacgcttcttacctcttccgttcttatttttcttattagtcccacctgcaaactcgtttgtcattctgtcggaagacatctcttcatcatagatggcgaccttctggttttcattctgcttcaatggtacaatatattctggtttgatatgtgcaatacctttggacggggaagtgtcttgtctcttcacggttgagttgtcgtcgccaacaatagagcgtttttcagcgttttgctccatcaataatgtttagaagttgcctttttttcctattctgagttcattaatgtttcattactgctcatctcatcactacacattcgaactaaattcttcataactttaactagatcttatgaaacttttcaaaaatggtgcacgggctttctgtatattgaactttccgtcgcttttcggagctacaattcccctacccggcttgtcggcattaagtctcttcatcccgtgtactattacccgacaggtttctgcggcatgttctgtggaacgacggtacgggcggtgactgggtgccaaacagtgcggcgttcccgtgcgcaaggtggtctgcggtaggaaaaagaaacaaaacgcgcctacgtcgtgcaaggggacaggattttgtcagttacataataaggagcaatttcgaatcaattgaaatttggaacaaatgggcgatgcattcgttaaaaggcgattttgtatcaaataacgtcactatcagccattgtcacttgccactgtcgcctgccaccgctattgccattatcatttgctttcgcatcgtcaccgatttaaagctctctaggctaacgtacgcattttacctcccaggccctatctcttttctacctgtcatccctatataacgtcttgtacattctagtggctccgttaacaaggtttgacaaatattacaatcaaagaaggatagcgctagtcaatctaatcattaagttcgcttataaagagaaggaaagctagattttttttctacttcaattacatatcggtgcttctctctggtggttttctgtttttctaatattgatcgattttacggtgagttaaactacttccttttatcgcaatatcatatttagagcgagaaagcaagaagaataaagctaggagaaaaaagcgccacgatacattcatactaagtttataatataccggtcgtcttttggctttctgataccatattatatcctcgaaacactttctctggattcacctactattaatcacctcaagatttcacttgtaaggcgttttcaaatttattgttattaaaagacatattcatattcagtatttttatttttcttcgaaacaggaaaagcttatctgagtatggattttacaacaatgactatggcaagcaatatggctactagtactactacgacggctacatcggcacatgcatctataaattcgtcatcaaactttaatattgatattgattcgaaccagaatactccttccattttgataaataacaattcggattcttctaatggaaaaaacacagattttaacggcgtcaataatattcaccaaaaaaatatcatgaataatacaaataatgttcatttgtactctccaaatataatggaccaaacgctactaactccacaggacattgccaagttacggagagaatcaatagcccattctcaagggatgggtggtgtttcatggggatccattagtgttggttcttggttaagagatgaaattattagccgtagaaatagtattgtacctgcatcagcaaacggtgctgcctccgctgccgcttctgcaaccactactgccactaatactttgcagattcaacaaccaactaagagaccctctgttagtaatccgccttaccatagagggtattctatttctcctcagatagcctacactgcttatctgccaaatctagaaaagcaatattgtaaagattattcatgctgtggtctttccttaccaggtttgcatgatttgctgagacattacgaagaagctcatatatccacgtctcctaacactaccaatatgtcacaaataccgatgaactctgctggtaacactagttcatcagttcgtatgacaaataatacctcttctgccaactataacctgcagaataacatggccgctaatacaaaaaatgcaggtcataagactaatactatgcaggctcatagcagcaatgcaactaataacacctccattaataatatgcatgccaatcttcagagcaacatggattccaactccacaatacgacaatctcagcatcctcaccatcagcagaatataatacaacaacagttgcaatcgaattctgtaaatcatacatcaggggctgtacccacaccgagtgtaatgggttcagcaactgcgtcgtccacaactgcaaatccaaatgtgatatctataacgggtgcccccaactcgggcttatctatggctaatcactctcaacaactacatctgaatggtaatctagtcgatgccgtttcaacgaatgatgtgtttttaagaacgagcaattctccatcaagacacgttccgcacaataaacaaattaacagtaacaataatagtggtatcaatatcaataataatacctcacacaattctaatattaacatgggtagtaaaaacgccatggtgaatcgtccacatacttttaataactattccttgaacaaaacgtccaggaatcctattcaacatcaatcaagaaaaattgatcctcatcaaaccgatttatcacctctggtacttgtccaagatatagatttaagttttatggatgatgatattttgggccctagtaaccacaattccatgaactctgtcgtaaatccaactacaggttctcacaactacaatacttttcattcttccgtacacgcaaaatcttctcaaaacatggtcgaggatcaagacattgatgacattgatgatgacgatgatgttgatgatgacgatgacgatgacgatgacgatgacacagaaaatggctccagttccaatggaaaatcagttcataacaacaattacaagatgcctcagcaagcttatatagacgatcctgcgagaaggctctatgtaatggatcatgaggaacaaaaaccctttaagtgtccagttattggttgtgaaaagacttataaaaaccaaaacggtttgaagtaccataggttgcacggacatcagaatcaaaaattacatgaaaaccctgacggtacatttagcgtaatagatccagattcgacagattcttttggtgatggaatgggctctgcaaaggataaaccataccgttgtgaagtttgtggtaagagatataagaacttgaacggtttaaaatatcacaggggccactccactcactaagatataattgtttctttactgaattgatttagtatgctatttagatactaattctaccgttaccgactcatgcatcgagcggccgctctttctcttgttgttgggcgcaatttatgtgatcatctttgaacgaaaatgcatgataaagctgtgctcttcgactgttaccattaatttcaaaaaataaaaagcatatctattattgaaaaatgaacttataatagaataacattttcttgttttgtcatcatttcctctaaatactccgtcatgaaaacgatttgcgctctgtctggtctctccttttagtattattgttgtgtgttttttactattcattttttactactgtgtttttactatatatattttggctttacttacttccttctgttctgatgtattaaaaactatttttattctaagaaaagaaactttaattcttcttattcatgctctaaatcttaaataaaaggttccgttttttatctgcaattctgtgtatttgtaagtgaattaccatgcacgttgtcggatcgtttttctaggcagaaactatcttattgaaccattaaaagattacttaaatattacaattaatcttacgaagcatattaattagactggaattacagcgcaactatcacaggttaataattggttgagaaaatattatagttttgttagtaatgttgaacttttattttatacacttatgaaagtaaattaattcaatatcaataataatatactataagtaacttaaaaagcaaccttcctcccaaacctacaatccaatcacgctgataagtattatctagaaagttgacaacaccaagccatatggtcaagaaacatttattgagagttattttgtaaataagacttttcgtcatccatataaagcaacctaattgttcatctaatactagagtcgctcttttgaaagttaagtataactacctcatcattagttgctactatgtgtataatttgaaaatctcaacgtaaggttattaaaaatataaatgcgcgtaagacagaaaaatagagacagcttacggcaaattatcaaaatgtgaatccaaggtttcaagaaaataagataaagtgaataggaaggatgaaaatcaatgtatcccgtccattacagtttttacaatggagttcatatattgttgttgcatttctgatacaattgctaatcattcttcctttatcgatcttaatatatcacgatttttacctaagactattacctgccgattcctctaacgtagtcccccttaatacgttcaacattttaaatggcgtacaatttggtacaaaattcttccaatctattaaaagcattccggtaggtacagatctgccgcaaacaatagacaatggcttatcacagttaatccccatgcgtgacaacatggaatacaagctcgatctaaacctacagctttattgccagagcaaaactgaccatttaaatttagacaatttgttaattgatgtttacagaggtccaggcccgctattgggtgctcctggaggaagtaacagcaaagatgaaaaaatctttcacacttctagacctattgtctgcctcgcactgacggattccatgtcgcctcaggagatcgaacaactaggcccatcacgtctagacgtttacgatgaagaatggctaaatacaataagaatagaggacaaaatatcgttagagtcttcatatgaaacaatctcggtgttcttgaaaacggagattgcccaaagaaatctaataatacatccagaaagtgggattaagtttaggatgaattttgagcagggattaagaaacttgatgcttcgaaaaagatttttatcttatattattggcatttcaattttccattgcataatatgtgtacttttttttatcacaggttgcactgcattcatttttgttagaaagggtcaggaaaaatccaagaaacatagctgatagaattgtacttctcgctatataattttaaaacctagctgttattttctaagtaagtaggctcttccagcattctgcttcttcgccctgaataaaaaaaagatgatcagcgaaaaaactcaaaatgaaaataagagatggattcttcaaagttataattcatatgcagaataaagattctaaagaaaatgcacacaatgcatattccatccggtgatgttctgataccgaagccgaagcttattactgaagaaacagatccactgcatataataaagacgaggcaaaagacacatggtcggcccgtgaccattgcaggcccaatggttcggtattccaagttaccattccgtcagttgtgccgagaatataacgttgatatagtttactcccccatgattttggcaagagaatatgtccgtaatgagcatgcaagaatctcagacctttctacaaataatgaggacaccccgctaatcgtccaagtaggtgtaaataacgtggctgatttactaaaatttgtggaaatggttgccccatactgtgatggtattggtattaactgtggttgtcctataaaggaacaaatccgagagggcataggttgcgctctgatatacaattcagatttgttatgcagtatggtccatgctgtgaaagataagtatggcgacaaactaagaattgaaacgaaaataagaatacatgaggcattggacgagacggtggagttatgtagaaagctatgtgatgctggggtagattggattacgattcatggccgaacacgtagaactaggtcatcgcagccggctaacctggatgcgataaaatatatcatcgagaacatcagcgacaaaaatgtgcctgtaatagcgaatggggattgttttaagttatccgatttggaaagaatcaccaaatacactggtgcacatggtgtcatggctgtgcgtgggttgttaagcaatccagcgttatttgctggatatactacctgcccttggggctgcattgagaagttttgttattgggctctagagtttggtggcttgccttttcaattggctcagcaccatctgtactgtatgcttgaaaatatggagttgaagaaatctctgttaaagaaaatgatgaatcttaaaaattacattagtctgatcgactggtttaataaaacctttgagttcaagcgttacggcgaggatggatttggcatgggcgttgaaattccttataaagctaatagctgtgtgcagaggagcgcctcagtggttgagagacaagaatgaataaattttgaattacaaaaatctaataaactgtggtactgaaattgtatatattttcctatcattcaagagcgtatactcgtaccccgaaagcagctctgtttgtgtaataatataacctaaaagaaataaaatgcttataagatggacattatttttttttttttacaatttaagcatcttcttcaacgacaacggtttgtagacccttagcagaggcaaccaaaactggttcgacgtaggaaaacaatgggttcttggcatcttcttcttcgtttctctttctggagattctcaatctcaatctgtattcaacacccttaacacctcttttccagatagcttggttcaattctggggctagacggacatcttcagtacccatgtgtaatttggcgaatttcttgatttccttcacagctcttggagctctctttttgaaactgacaccatgtagctatattaatatcaattcaagattggtctgttagtaaaaaaaaagttgttataagaaggtggaactaaagcatcacgccaaaaacatcggcccaagcgccattatagtgtaaacgtgaggtacggatatcgatcgcagaacacagagaaatgcagtaccgaagaagaaccttccagtccttgcatcacgcattccatataataacctctaatattccgaattaaaacctggggtcaatcattggaaaatgaaatttcacccgtatagatttcgcttggtatttcaccacaatatcgcttgttggctttcaataatttcccacgtaaagacaacgctaatttcgacatactcttttgtgcaagttgatggtgtattcacgagtgacaacgtcttttaaaccggccattttcaagtactttggattatctgctcgtgcaattgaaatatactaagacccaagactatgtaaaactaaggaacctatcaacaatgagactggtcaaataatagagtaaacatgtacatgaagcactaccatcagaaagagcttacaaggttacgaaacaacgtcagtgccctctgtcgcattaccctcggtttcgcgcccttccagttggcatttgaagtgccaatccaattgtgagcacatccaactagcgtgcccttgcaatcccagaggacaccatacaacttccagcctagtagtgaacttaccaggcgaggagcgcgggcgccagagggcagctcatctgcgttccggctctaacgagaagggcggaaatggcaccatcacctgaaaaagaacgtaatctaggctgagccgcgcctttaagtttttgtcgcatctggctgcgcttcatttaaacggcactcctaaaaaattgtatgaggtgattttttttgtgtacagatgtacggatgtacggatgtacggatgtatactatgtaataatgcacggatgtagagaaacagaaacgaggataataaaatcggtttttgtatcatctggcggcgatatggcgcaaggctttaagtaaacgtcctatatggtactaacggggttttattccgaatcaaaagaaaaagagatacgaagtctctcttagtaaaaaagtctttatggaagattatcgataattcgataattctaccgacaacagtggttttgtttggctcagcaaacgtgcagcaccatgatcttggtagatttcttctttaccctcaccttccccacaccatgtttgcttgctacccgtgtgtaatgctatcagcgcgcgtttctttttttttcttgctaacatttttcaactttaaaatgaaacgatgcatgagtgatagaggcattgaactttagtaaacaatagaaataaccatcggagttattatttttttctgcttattctttggtcgcaaaaaagtgtgttgtataattctttggaatatttataaaaacagggaatactctaacaacaaacgctagtgcttagctactcttccgctggtacttcaatatagcttgtcacatatttttgtccattaaggtcgttaaaacccgaataattttgtacgatcagtttagtaaaagaaatacagtattcaaaagctaacggtttattatgactgtttctacttccaagaccccaaaaaagaatattaagtataccttaacacatactttacaaaaatggaaagaaactttaaagaaaattacccacgaaacgttgagtagtatcgatgactctagtggaagcgatgaaaaaatagaggctctgtttactgtgtctcagcctgccgtcgtagcctccaagggtatagacagagatagtggtgcttctatgtcgcaggtaggaggaggtgtcaatagtacattggagatgaagctcacagatgagagtgaggaatctagctctgctaataacacgaccacaaccgcctcgcatactctatcgaattcgaagaagtctacgcagaactttgaaaactataacgtagtggaggaacgcataaaattagcacagaaaagtaaggcgccgttttgtaacgctgagaaaatctggaaacgaagaagacaactctggacacaacccactgagcaaagtgaaagcgccaataatgacggagttactcgaagggagattttccaagctatacctcaggaatattatgctctagtttacaagaaactggtggtagatgataagccattgagagagcctctaaatctggaagatgctttacaagtcataaatgcaggctggacggaaacgagaaagtgggctaatgctgccaagggcatgccatgactgagtgtcgacgtcctttttgttttgccttatagcatcttttcctttcttcaaatttgcattacacaactttaactcagttaaagaacttcgtcatttacttattcttcttttttttcttacccttctttctcaaatcttatttctgtataaaatacgtattgattcattccattaataataacatataataatagtactaatttaaaaacattgaatatatttatcgttttatttcgagttgcgattcttttctatcagttggtacgtcatttcaaggattcggagatccctatccacaagctctgcttccttttgtaatgcttcggtatgccccatatacggagtgtacttttccaacatatagttaataggagaaacacacttatttttaaatgagtcgtcatgaagtcgcaataacttcttcaactgtacatttaaaatatatgattgattattttcaatttcttgcaaagtcttcgaggcttctgttctatgcggagagttgattattttgtcgagtaatcggtcaagttcttcagacctgtttggcatttttacgattatccagttcacacacattgagaatgtaaggaacatttatttattgtcgatcatttattaaatgtgggagggaccctttaagaacactgcaacaaacccaataaataattcttggttaccctctcaaaaaacatcataggaaaaagaaaaatatacaatctgcctttgttactaatatacttgttctatataatgctcacgcggtggtcacaaaagttgccactcccatgcaaaacttcacaagatcatctaatctgtcttccttcttatgtacatcctcccaattttgaagagcagaggcaatatcttgattcttgttgttagcatgaataacatcaccgtgtgccttaaacagtaagctcataaacgtttcataaagttcgaaatttttattgctcttcaacccctgtgttaacgcgtcgataaaccacacaatttcatcaaatggctcaaaggaattcaatgatcttatctccaaatccactgcagcaggtgagaaatttattagagtggccagcaatgatgaatagtccttggattgtgagccctctcgtaattgctttgtgaaatgtgattcaaaccctaatcttcctgtaactttgaatttattcatttgctcttctgcatctaacttcttttgtgcttcttgatctctgcgatggatttcttctggtgtttcatgtgctatgccttctctgacagaggcttcatccccaaccttttccccagatagttgcaagaaaaatggaagcttttctgatttctttggagcttcctttggcttagaacgttttctgataacatctaaatgaagcaatgtgttcattttacttctaggtcctattgataaagtcaacagctccttatcaatctgttccaatgatgtataagtgttgaaatcaatatcatttaggtcttctcctccattgctttctaaagcccctgataacatcgagtcgttccctcgaacagatgtgctaggtaacgccattcttgcaaattcagactcatcgatggttcttgtcgatactgtcttaaattgtgctctgttcgtccagatgcatataccattaccagtaacatgggtagtggcaagcaagtcaccattcggagaaaactttacattcgtagcgacattatctactatgataccatcgatacatcctccggttggaagatcccacgttctaatggtggaatctagagaagcggaaacaatccaacggccctcaggtgagaaatcaaatgcagttattctattactatgaccccataattgacgaacaactctttgagtaagtgcgtcaataacaacaattgataagtcgtctaaagccaatgcaaatagatcggaagaacgatgataaaccattgcggtaataggtgcatccaatttcaattttcccaacaaggttgacttgttaaagtcataaaaaccaacaataccgtctagtccacaagaaaccattttacgattcataccatctaaggatataccggtgactgctcttttgtgcaatttgtattttttacggagtataccactttgcatattatagatggtgatagagccgttagaagaaccgatgaatccaaaattaccacattgcgacatggccacagatttaacaaatccatcatcagtagtatcaaaagtccacctgccaactcttttatttcgcatatcccaggttcttgcaaacttttcatctttatgtgcagtgataatgttttcccattcacctattctggcattttcaattgcaagagccactatttcaggaaatttagacttaattgtactaccacctaccctgccgccatcttgtttcttgtgtaacctttgtgacatttcttgcgactgtgcatctttacgcagagaaaagctccataatgatctatctttggatgctgatagcatgaagtgtgattgcgaatcagcaaacgcaatgtatgaaggtggttgagaatgaccccctctggaacgtagatatcttggcggttgaacaactacatcaccgcttccttgagataatgacggatcgaaaacgtactccttcagggaattgtcaccacctgatgtaacaataatgggttgaccatttaaaaaagtagcctgagtgacaccaccgtacgattctctatgaatgttcttcaaaacgtgtattcttgaacggcgatctaaatcataaaatattagatcaccactgctcgttcccacactcaaatgagaagaaccgtcggttctgaaactcaatgaggagattcttgattgcggaatcttaattgtgcggatccttttaccttttctcatattaaacataataacctcacctgtcacggtacctagagcaataatatccaggacgggagcgggttcagcagttgtgatttggtctggaaattcgtttgatgtgaatacaagcttcccggttctgacgttaaaaagtaaaacgttggatttggtaacgacagttaatttattcaaataagttgccaaatgttgtaaagacacaatttcgccaccttgaatttcagtaacggtaagtttagtgtagaattctgatggatatttatcttgcggatcggacttcttgtatataaagatggaattgtcgtcggtggaagcgcaaagataatctccgaatatgcacaaatgttcgacatttgcatcagtttctagctcaagcaaatgttcctcaatacccctcttgtaaataccaaccttgttttcatatgctgcgtagacgtagtgaaagtgtgctgataatgctacaattgaggatggtgtttctttctcggaaacaaaaagtaaatgtaaggtattcgcatcatatatctgaaatgttttaccaacacacgttacaatgtaaaaggtagatcccaatgtaccagtagcaaaaggaacaccattgctaacattaccaataatccggaaaggggaaaatatcttagaatttttccctctacttcttacgtcttcttcgacttttctttttttcaagtcgatagacataatgtacttttcctaactcgctatagccttttcagtgtcttattccttgctgctgtttcgctgtatatttattgtgcttaggacttattaaatttcattagcaatctcatcgcgaaatttttctcaaaatttttcagttaaaaaaaaaaaagcacgtgctcaaaaatgtttttagaaaatcatttatttaagataggaaaaatgcaattaatcattgaatcaatatgttcaccacttaaattacccactgagcatttcatacaaattcaaaagcatctcgtagcatattaatatattgcagaaggtcatgagtgggataaagaaggaaccgattgaatctgatgaggttcctcaacaagagacaaaaaataacttacctagtgcaccttctgagatgtcaccccttttcctaaacaaaaacacacagaaggctatgcaatctattgcaccaatattggagggtttcagtcctaagacgtcagctagcgaaaatatgtctttgaagttgccacctccaggtattcaagatgaccacagtgaagagaatctcaccgtgcatgatactctgcaaagaaccataagcactgaactaggaaacggaaacaacaccaatacagttacgacttccggtttaaaaaaggcagacagtgaatcaaagtcagaggcagatcctgaggggctcagcaattctaacatagtcaatgatgcagataacataaattccatctccaagaccggatcaccccatttacctcaaggaacaatggacgctgagcagactaacatgggaactaactctgtacctacttcatcagcttcttcacgcaaatcctcgactagtcatcccaaacctaggctacccaaggtagggaagattggggtatgtgcgatggatgcaaaggttctttcaaagccaatgagacacattttgaatcgtttaattgaacatggtgaatttgaaactgtcatttttggagataaggtgattctagatgaaagaatagagaattggccaacttgcgactttttgatatctttcttttcttcaggatttcccctagataaagcaattaaatacgtcaagttacgcaagcctttcattatcaatgatttaataatgcaaaagattttgtgggacaggagattatgtctacaagtattagaagcctacaacgttccaacacctcctagactggaaatcagtagagatggtggtccccgtgccaacgaagaattaagggcaaaattacgtgagcatggcgtagaagttaaacccgttgaagaaccggaatggaaaatggttgatgatgatactttagaagttgatgggaaaaccatgactaagccatttgttgaaaagcccgttgatggtgaagaccacaacatttatatatactatcattctaagaacggaggaggtggtcgtcgtttattccgtaaagttggtaacaagtcttctgagtttgatcctactttggttcatcctcgtacggaggggtcttacatttatgagcagtttatggacaccgataatttcgaagatgtgaaggcttatacaattggtgagaacttttgccacgctgaaactaggaaatcacctgtggttgatggtatagttagaagaaatactcatggtaaagaagttagatatattactgagttatcagacgaagagaaaaccattgctggtaaagtttccaaagctttttcacaaatgatctgtggtttcgatttgcttcgcgtttctggtaaaagttacgtcattgatgttaacggattttcttttgtaaaggataacaaagcttactatgattcatgcgccaatatattgagaagtaccttcattgaagccaaaaagaagatggatatggaaaagaagaatctgcccattattcgtgaagaaaaggaacaaaagtgggtattcaaaggactggctatcattatccgtcacgcggacagaacaccaaaacagaaattcaaacattcattcacttcgcctatttttatatcgttactaaaaggtcacaaagaagaagttgtcattcggaatgtaaatgatttaaagattgttcttcaggccttaagaattgcgttagatgaaaaagcaggaaatccagctaaaattaaagtgttagcaaacgctctagaaaagaaactgaattttcccggtacgaaaatacaattgaaaccggttttaaataaagagaacgaagtggaaaaagttcagtttattttgaaatggggtggtgaacccactcattctgccaaatatcaggctacggaactcggagagcaaatgagacaagattttgacctattgaataagagcattctacaaaacatcaagatattttcatcgtctgagagacgtgttcttcatacggcgcagtactggaccagagctctttttggggccgacgaattaggtagcgatgaaatcagtattagaaaggatcttttagatgacagtaatgccgccaaagatttaatggataaggtgaaaaagaagttgaagccacttttaagagagggtaaggaagctcccccacaatttgcctggccttcaaagatgccggagccatatttagtcataaagcgagtggttgaattgatgaattaccataaaaaaattatggataacaactttgctaaaaaggatgtcaactcgatgcaaacaagatggtgtacttctgaagatcctagtttgtttaaggaaaggtgggataaacttttcaaagaattcaataatgctgaaaaagttgatccttctaaaatttctgaattgtatgatactatgaagtatgatgctcttcataacaggcagttcctagaaaacatatttgacccgggtcttccaaatgaagctattgccgatgaactcggcagtcattctttagttgaccgttacccaattaacgttctcgccaaaaataattttaagataatagacagtcatagcatgaacaattctggaaagaacagtagtaatagtgttgggtcgttaggatgggttctggaaagcggaaaaacatctacagcaagaaaccccaaatcttcttctcaattcgatgagccacgctttatgcagttgcgggagctgtataagctggccaaagtattgtttgattttatctgccccaaagaatatggtatttcagatgcagagaaactggatatcggtttgttaacttcgttgcctttggcaaagcaaatactaaatgatataggagacatgaaaaatagagaaactccagcttgtgttgcgtacttcaccaaagagtcccatatttacactctattgaatatcatatacgaatctggtattccaatgagaatcgctagaaatgctttaccagaactagactacttgtcgcagatcacttttgaactgtatgagagtacggatgcttctggtcaaaaatcgcattccattagactgaaaatgtctcctgggtgtcatactcaagatccgttagatgttcaattagatgacaggcattatattagttgtattccaaagatttccctgacgaagcatttggatatggactacgttcaacagaaattgagaaacaaatttaccagggtcattatgcctccgaaatttacaccagtaaacattacgagccccaacttgagtttccagaaacgcaaaaccagaagaaagtcggtatctgttgagaagttgaagcttcctgcctcgtccggatcttcatcatctacctccgttaacaagacattagattagtgatcacacccaatttttaatttagcaacccaaaataaataagtatttactcaacttttttttaataaaaaaaaacttaattgaattttgctcgcgatctttaggtccggggttttcgttgaacccttagacgagcaaattagcgccataaggatatacgtcagagcacattaattagtgacatatacctatataaagagcaaccttctccgatagacttgtaatttatcttatttcatttcctaacactttggtcgaagaagagggataagaacagacgaaaacacatttaagggctatacaaagatgaatatgggaggcagtagcagcactgctgccaaaaaagcgacttgtaaaatatcgatgttatggaattggtataccattgacacctgcttcattgccagatcttggagaaatgacaccaaaggaaaatttgctggttcttgcatcggttgttttgcgcttgtggtgatagctcaatggcttactcgtttttcaaggcaatttgacgtagagctattaaaaagacagaaaataaagcatttagctagttactcgccagaggagtatgttgtcaaatgtggagatgaggatgctaaatctgatatagaagaactacaaggcttttacaacgaaccaagctggaaaacaactttaatttccttacaaaaaagtttcatttatagtttttacgtttggggtccaaggagattgaacgagccagaagacgacctgttaaagaaggtcctatcatgctgtacattaataacaccagtggatttgtacccaacttttttggatcacatgataagagttactattttcgtattacagtgggggttatcttatatcatcatgctgctgttcatgtactataacggctatatcattattagttgtttaataggtgctatcgttggtcgtttcatattttgctatgaacctctaggctcattgggtgctaatggatcagcccagggtacagtgagttatgataaagagagcgatgatcgcaaatgctgcttgtagaaagacaaaaatgaatagaggaaagaccgagaggtttgtttcaaaaattgacgccttcctcatttttttcataattagctggtaaaagttactatttgtaacgactgctaaataacaaataattattcgtgtaaaaataaatagctaataccaccaggtgttcatattccatgactgcatatttgggaaacgagacgggttgaacatctttagttgatgtaaaactataataaaagctctatgggatgtaaactatctgcgggtcgggtaaggaatgatgcttgctcgacgtgtagcgatgaaaaaagtgaaaacttatttaaactctagaaaactgctaatatcctgaactgataccgaagttaatgaccttgaccggtcttctgctgtatggattttaaagcaagtgggacaaagtttaagaaaactggcaagaaggtagtgcctgctaaagcgtttgaagagattgttcagacaaatagagatgttctgaaaaaatcagcattcctctcagatttacttgaaaatttacaaccgcacctcaataacattaagaaaatacgatgtgttgcaattggaaatttcaaggaggattttcctgcgacgtaccaattcgctcttctcctagagattattgattatataaaaagtgaggatgaaagggatgtcgttgtttccctgtatgatccaatatttaccaaagaagagatacagtacttgaaaagtttaggaagcaaatggctgatagaggaagagttttcagagaacgatgcaattgattatgaatcggtattatatttccttccccatgctcctttggatttaactgagaacatactatcgtcacagcgaccacacttatggctggcaaataatatgatatcacacaccgatagatacaccaaagcaaaactttgtgaaaactatcctaatttaagcaagctagttcattacttgcagactaatgctccgccagaagttaaaaaagcacatgatgtagatggttttgcaacattcattccaaagagaaaaagaaaaaacagaaacaactcctctaaactcaaggtcacaccatctgatatagactatgattcaatagcaccgaagtttaagtcctgccaaatactcaccgattttgatgaaggaaagtatttgaaggaaaaaccctggatcaattccttctctgacttgacgttacatgctatagagtactaacatatcattcactacatagtactttataactagactgtaaccttttagggcatcgtgacctgacgctttaccatcaataacgacacgagaccgctttatctatgatactggaacaatcaacatgattgttataaatgtactcgacaggatcatgaaaggataccgacttagttgccagttcattgaaatggaaagctcaagaacgtatactgaaagagagcgacgtctactttgcctacaaaaatctactctctgaattgaatagtatttagagattgcataattcaagccctccttgaggaaaggatataaatgaaaataccgtttttcctgctgatggttatcgtccctgtcaaggatacttctcggactcgaacaacgttacagctcaacttaaagaaggctaaatacgacaagggcgcttgccctaagaggaactgtttctaagttctaacgagtgcctgcgaagatcggttttttttaacttcgcgggcgaattgataaataaagttcttcttgcaattttttaagatcaaggttggggcaaaaaggacgcaaacgaatggttgggttaagaaagtggaaagacccaaacctgaagttcatttagttcttggcggaatgaatcattcgaacggcgcaatacgctcatcaaagaaggaggtatgatttatgacggtttgtgggtagccctctaaacacgtggagagtaaccttttctgtttagcgatcctagaactgcgaacaatgttagctattcgcttactcaacaatattgttcttgattaatgcattcaaatatgtaacttcgtccctcatataagcgtctgacgcgtcgtggaaatttaccctcttaagaaaatacaagagattacgtaaaattagaaaccaaaagatatgagtggaacagacacatatcacccatatttccttttcacgtaaggaaacttaagtactagtgcggtgcctgcgttagtgcttgtctttaggtcaaacaggtcatcttgaccaacttagcttataataagaatgataatcgattactctaaatagcattctttcatttgcggcatcttataacccacacaccgcatttaggacccgttttttttcttttttttttgttgaaaaaattcaacagttcggtatttttttcttttcattctttttttttttgccttgccttcgtttcgagaattctttttctttttctttaggtaagggaccttctcagctgaggcacggtggggtttgtaatagtgtccattctggcacaaatgcataagtgatgctaaaatagtgatacgtctaaacaaaacggtttggatgcctagcaaatagtaaaaagacttgaatatatcacttttatcactatgtaaaaaaactgagttatattattaagttttttttgaaatgttcccgtttgacgtgtatttagtacagtatgttccgtggatactgtttaggtgcatttaagcgctccagaactctcctttaaattcctgcagcactccgtcagttgcttcgtaaatccgcctggataccgccttgaagattaaagttcccctcagtactcgtttagcttgaatacaccgcactatggcctggtaaattctctagttgcttttttctatacggcgtcgtccctggaaaaaaaaacttgcctatagatcttagtagacaaatttaactacgtcaatctattgttctgcttaaaaaaaaagttgaaattgttaaatcctcaacaaacttatcgcttttcaagctgctgcaatcatagatcttacacttctacacagaatttttttttcctgtaaaaagaacgacaaaatatataaacttttgacaatctagctgcatttactcacattaagccttgagattttcatttacttcataatagcttgtagatgcgatgctgatacagtaaaataaaaattcagtaatacagtcaaattattgcgatgaattttaaaatactcctcccgatttgtgctttattgacacttacaacatttctattgaccattattgcaactgcgggttctacctcaaattataagccaataacgaacatttatatcggtgatgctgatatatcaaaaatcaacgttacaaaagttatgccacaagttggcccaattttgaccgtgttaggttctgctctaaccgctccaaatacaacggtggataccatcttcggcgctcttaaggcaatcgcttctaccgaagccttgtctcctttactgcacttgttgtctaatgctgctaacacttcagccacattatcatctttgacacagttggctccaatggctttgctaggaaccaacaccgctactaccacggccttctccgctcttgatgagttattgactacctctaaaaacacaaccgaactcttggatgggtttagcacattgatgtcatctatgtctaccaacacttcttctacttcggcttccttagaaaatactgttctaaccctattagtggattcgaccaatcctataggcactactgagtctttgatcactttaaataatatgaccacagaagaaaagacaaaattgtcgcctgtattcgagttattcgcaagttccaagaacattactgccacatgcgatgcgttagaaaccataatgaactctaccattccaacttcaacggtctcctcattgttttctagtctaaaaaccagtcttgcggaaggtggcaatgctactgaaactattatgcaattaggctccctcgttccttcgagtttaaaaccagctgtccaagctgttgttactctgtttgatgaaactacatctcaaaatgtaacattatccgtattgagcactatgattgccgaaaacattacccaatcatcttccgctaaagctgccatgggtgctttgactgacttgttgaattacactacaaaccaaacagagctgctaacatctgtcgaaagtttggccctctctaaagaagccgcttcctctactaatcaattggtggcacttgatgaaatcctttctgcaagtgctaacgcatccacagttgtttccataatccctactttggaatcccaattggccaataacaccgtattacttaagtacgttccatacttgttcagcctattagctgcgtcaagcgaccccgtgtcaagtttctcttctctggttaatatcaccaaatgggcagaaactaatgccgctacatttatgcccatgttgaaaattttaaactctgctgcaaacatgacaactatcacaccagaacaactcaaggaaatgactccttctatccttgaatatctacacatccctgtcatataccgtttgtccattttcacaatgtgtcgtgctcacttaaacagaacaatgtactcgtgtagcaagtcacacgctgttcaaaacatggatttccggtcgattgtttacaacaacattgaaggctcggactttaaaccttatatggatgccctgaacatcggtaaggacgatttgcatttagatggtgaattacaagacagacaacacatgtatgtcccagcagtgaaagcagctttagctatgaacttaatgtgcataatcacatccttcttcttaatggtattcttgttgctactaagtagacgttccgtggtgagtcaaaaattatggttggcattgggctttatttcctgttggatatgtattttcagcgggttgggaagcacaatctttagcgtcatccttaatatgatgaaatccggctccaagaaggacaattacgatgtcattatttctggctcttctccattttatggcctaatgtggtctggatttgtatttgccgtccttgtatttctctgcattgcatactgcttgtggatcagcagaaagggagctgccatcgtggaagctgagaaagctgttcaagaaagtgactctactacctcaagaatcattgaagaacacgagagccccattgatgctgaaaaaaactttgcaaggtaaaataataaaaagaagatcatgcaacatcaccccgtaaattttttcaattctccatccttttaattttcttcattataattttctgaattgtatatagacaatatattttaatcatatttaatatgaaacggaacacaaaaattaattaataaccttgcctttttcaaattcaaatcaatggtttttcctcaattggagcgttcgcatagatgacggtgggcctcgatctcacgctacaccatagaatgaaattcagtaatgctccaacgacagccccccacatcaaaccctggtagttcctaccaatgctcattgaaataccgtaatcactatagttatgctttaggatgtatttgatgtatgagtaagtgcccaaacacgaacctatactgactaatagggcggcaaaggcgaaaaatgaaaaaaaggcaccaaaccacgttagcggccttatgtggatgatccagcgcaatacgttgaacactagattcacaaaggtcaagacaataccaataagaatggtaatgaacatacacttgaccaaattgttgtagtatgtcattttactttttagtttttcgggcaaaacaacactggccacggaatccataagctccagagcctcattgttgttgatattgtcatacactaatgacgataggttaaaattctggataccgtgaggcgaagaacatgattgtatgttatgcgaggagtccactgtacagtacgaccaaagccctatatttatatatgagggcaggcccaacgaagatagcgtagcagaactcaaagaagggagcaccgtcgataccttcatctgcgacagatccaattctgcacagtaaattttatttatgggactataatttttcgttgatcctgcgcatgcaacaatggctaatataagtgctcctagcgaaaatatagctgcaaaaaataacgtgaaaaaattcctcatgcttatagcgtccttcgatgatgtgtttgtttttttcttaatagttctctattgctttaatcaagtttcactactgcgcagcgttgtatgatcttgatctagtttcttttagttctacttccaaacaactggtccagaatgaaacaccactggacactcattgactactgagacatggaagagcaacattctcgcgtatatatacttctcagccaattttcctgcgagaagcgctaaaaataccgagctgggcttggctgatagtacgcccgatttggaaataacgctcgaggcgtgctgcgtccttttttgcctggccaggccaggccgggttgtcccgcaccattcaacggcggctatctggcgatgttgaaagagggggggagtggagagggctctgagggtcaagtgggaggctgtgacagttctcataagctgggcactgagatacatggaaagaaataggctgttcacagtgtacgtcaatgtgtggctgactaaccgttagcggggcggaaccgacatgtctggtgcagtgtatgtaagaaaaaaagaatgacaatgcatggccaaacttttgatctgtgacgttcgcaaaacgcactactttgctttctgtatgcaatgggaatgaggcgtagcgacatattaagaagccttttccatgtgaggaagcttcgccttgttttccagacgcgctttttttaggatcaacgaagaggaaaaagggtttcacatgtttcatctggaaaagatggagactgaaaaacaaaaaagcagagaaaaggtcatccaagatagaataggggacctcggctaggaatcaggaagtgtgttttgaaagtcattctttttttttcaaaagatggagtactggcattatgtggaaactacgtcatcgggccaacctcttcttcgagaaggtgaaaaagatatctttatcgatcagtccgtaggtctttaccatggcaaatctaagattctacagcgacagaggggcagaatctttttaacgtcacaaagaattatctacatcgacgatgcaaaacccactcagaactcgcttgggttggaattggacgatctagcgtatgtaaactattcatctggcttcttgaccagatcacctcgtctgatcctgtttttcaaggacccctccagtaaggatgaacttggtaaaagtgcggaaacagcaagtgccgacgttgtttcgacgtgggtctgccccatctgtatggtttcgaacgaaacgcagggggaattcactaaagacactctacctacacccatttgtatcaattgcggtgtgccagcggactatgagctcaccaagtcgtctataaattgttctaatgcaatcgacccgaacgccaacccacagaatcagttcggagtgaactctgagaacatttgccccgcctgtacttttgctaatcatcctcaaataggaaattgcgagatttgcggccacagattgcctaatgcatccaaagtacgatcaaagctgaacaggctaaactttcatgattctagggtccatattgagctagaaaaaaattcactggctagaaacaagagctcgcactcggcattatcgtcctcgtcctcgacaggatcatcgacagaattcgtgcaattgagtttccgcaaatctgatggcgtattgttttcacaagctacagagagggctttggagaatatactcactgaaaagaataagcatattttcaatcagaatgtggtttctgtaaatggtgtagacatgaggaaaggggctagttctcacgaatacaacaatgaggtgccatttattgagactaaattgagcagaattggcatatcaagcttggaaaaatctagagaaaaccagcttttgaacaatgacattctctttaacaatgcgttgaccgacctaaacaagctaatgtcgctggctaccagcatcgaaagactatacaaaaatagcaacataacgatgaaaaccaagacattgaaaaccaagacattgaacttacaggatgaatcaaccgtgaatgaaccgaaaacgagaagaccgctattgatacttgatagagagaagttcctaaataaagagctgttcttggatgagattgcgagagaaatttacgagttcacgttgtccgagtttaaagatttgaacagtgataccaactatatgatcataactctggtagatctatatgcaatgtacaacaaatctatgcgtataggtacaggcctgatatctcccatggaaatgagagaagcatgcgaaagattcgagcatttaggtctaaatgaattgaagttagtgaaagttaacaaaagaatattatgtgtaacgagcgaaaaattcgacgttgtaaaagaaaagctagtagatctgatcggtgataatcctggttccgatctcttgagattgacacagattttgagttccaataattcaaaatcaaactggacactaggtatccttatggaggtattacaaaattgtgtcgatgaaggcgatttactgatagacaagcaactgagtgggatttactactataaaaactcttattggccctcgcatatataagtaataaatgcatggtttgattacctgctcgtaatactacattctcccaaataaatagtttacatataaacgcgcggctaaacttcacttcgttacttgaaatgccaataataacacataacgtagagtacaaaatcggaatacaaacgccgactgaagaaacactttcaatggccgaaataccattcttccgtttatcgtattcaacggtatcctcttgaaataagttccttttctaaactatgccagaaataacgcacgacttccacatccttaaatcttttatttttgtcaagttcgaccttttctacattccattgctgcacgtgttgtggtacagaatcaccggcgaaatggaaatagtagcctttgcagcgttgaaataattcctgtggtgaattccattgatagttattaaactgccacgtatgaccagtagtgaagatagcgacaactctgtcccaatattctggcttagtaaacatcctagtgttatcgactataataaatctaattggtcttgatatacgttcgaagtttttctctatgttaactaatccgtttggcactgacggtaagttacgaggattcacgtattttgactccagcaggaactgttttatatttgcaacagttaaaattgatgacgcagccgaaggaatcaaaataattggatctttgcgagggccacctgatgaaccatttgttttggaaatacgaccgtgcgcgcccttatgaccgggaggcaatttagatcctcgtaaagatcctttgatcgactgtactaattttagttctgcatcttttattagataaccgaagttgatcggcttagcaccacgcaatgcagagttgtggtccaccaatatacgttcatgtttcattgtttccaccacaactggatcggaaacttcactatcattttcaagagatgctgaagtggttgattttacagtcgacaattcaccagccaaagttttattttctatatctactttatcggatgtctcgcctttctgaccgggtgctttcagatattgggatgattccgtattgccagacaaccaatttattaaatcagttctttgtaaaaatgaaacattagtcaattgtttattctgacagtctgctagatagtctgcggcacttgagtccttattcatccaacaatgaacaattattcgtaactgtaccaatgaaccatcaatctcaatttccgtttcttcattcaatggaaaactatcttgggtactgccatcactggatagagtttctaccatggttgctttcgtaatatcgtcagtagactgtccctcattattttttagaaccagtttatcgccgttctttaagtgttctctcagtctgtctaatgagttcgccataattttttcaccagtttcttgctcaaattattattcttttaacgccccaaattaagaaacagcctgttttggaaaacaatttggaaaagggtggaatattcgttgaagtacttgttttaaacctgtccaatcgaaattttcatccttatgctttgaaaacaatattgcgttgccggttaaccgtctcggtgttcgatgagttgaaaaattatacactaaaaagatacatactattcaaagttgtaaaagagactcttagctaagggaagtattgacaataatcattcaatttatactttacatcgcaattgctttcattaatttttgataaatggccaaaaaaacgaaaaataactcaaaaagttcaactccagtgaatgatgtaccaacaactgctggcaaaaagaaagcaaaaggaaaaaagggacaagaaccagagccagaagatgacaaaagggccaagcaacaaagtaatagagcaaaagtgacatccacagcaagctggacaggtaaattgcctcatacaatcttacacgaaacatgtcagaaacgaaaatggaataaggtagagtatgatatgaagaaaatcggtgataaaggtttcattgcaattgcagttttgtcattcactgacccaaagacaaaagaaacattgactgcaagaatgaacgatccaacctatgacaaagcttcaggaaaaggccttgtaattcctcaagaaactccaattgaagctagacacatggcctccactattgcgctatatcgcattgcatacaacaccaacctgcacatgatgcttccgccaaaccatagaaaaacatggtatgccctcgacgattttcgaaaagataacttgaaaacagacgaaaagcgtataaacaaattatttgatcttgatcccttcaagacaatggtggaagacagaaagctcaaagcccaacgtgaaaaagaacaagtggctcagaataatcaagcacagaaagaacaagttgcacgaactattttatctagccatggtggaatttcttcttctggaaaggacaggcaagagagaaaagtagcatctcataaaaactcacataatccttcattagtgcggtttccaaaaaaggtttgggaaaattctatatttgttgaccttgatgaatcgtctagacaactgatagaaacttcattgaaagagaaaattgattggcaagctaaaaaaattagccataaaaatgagacaattgctgaaaatcgggaagatctcaaggcaaaattattaactctacaatttagaccaaaacacgtagaggaagccatgctttataaagatccattgtctttcttattgtttaacttaccggaagatgatttaccaccattttttcataaaaagaaaggtgatacaaaaaacaaggttgaaataacaaacctaccgttatcaactagaatgatcgttgaccgtttaacagaaattggtgtctcttcagatgaagccttattggctttacaacaaaacgatatgaatgaaaatgaagcggccgggttcttgacgagggaaattttaccaactttaaatagcaataagaatgaaactgtatcggaaactgaatctatcgaatgttggaaccaagagctagagagcctagagagcatttatgagggctgcgtgatggacgccaaggaagattcacactacacgctcaatttaattgaaaaactcaaaataaaattgaaagtatatagaaccaaaaattatcctgcatcattacctggtattgtagtttcaacctttgataaaaattacaagctacctgattatattaagaaacaaatattaaccaggttactgcattatctccaggaaggaaatctaataggcgatatgttagtatatcatatttatgaatggttgaaagagaatatatctaagataattgacaaccctggcccattaattccagattcagattcgaaaggtgcaataaacaaaagaaacatttcaaacggtaagagaagtataaataattctaattcgagaaaatttacaaaaaccaccatttctgaagacacgctctctgtcctaagggaagagtacacaaaaaggatcaaaagttctgaatacaaaagtatgcagttagttagagaacaactgcctgcctggaagaagcaaaaggttattatagatatcatcaataaaaacgaagttgtattgattactggtgaaacaggttcgggtaaatccactcaggtcgttcagtttatactagatttcttacagaaggaaaaaggagatttcggtaagactaaaatcgtatgtacgcaacccagaagaatctcggctattgggcttgctgaacgtgtttctgatgaacgctgtgtaacttgtggggaagaggtaggttacgtaataagaggtgtcaataaaaccaaagcttccacacgtatcaagttcatgaccacaggtgttcttgttaggttgttacagaatgctagaactatgttagaaaacacaattgttgttattgatgaagttcatgaacgttctattgatactgacttgatagtgacattgatgaaaaatctcttacatagagttcgcggcatgaaaattgttttaatgagtgctactgttaacgttgacttgttcaaaaaattctttccggggctagcaacatgtcacatagaaggacgcactttccccatcactgattacttcttggaagacattcttagtgaccttgacttcaagatcaagagagagaaggctttgtcttatgatgatgatagcgttgatgaaagaaataatgacgaccaatatttgaagccgagagcagattctaagttttttacatctgggcaaatcaattatgatttgctttgtcaagtggttgaatatgtacataaacgcctgaaagctgctaatgacaacggatctattatcgtttttttgcctggtgtgggagagattaataagtgctgcaatttgctagctaataaatcaaatgaagcagattttatggttctacccttgcactccgctctaactcctgaagaccaaaaaagggtgttcaaaaaatatcatgggaaaaggaaagttgttgtatccactaatattgctgaaacatctattactatagatgactgtgttgcaactattgacacaggccgtgccaaatcgatgttctataatccaaaggataatactacaaaactaattgagtcgtttatttcaaaagctgaagttaaacaacgtagaggtcgtgctggtagagtacgtgaaggtttatcttacaaattattttctaaaaatttatacgaaaacgacatgatatcaatgccaattccagaaatcaaaagaatcccgttggaatccctttatttatctgttaaggctatgggtataaaggacgttaaagcgtttttgagcacagctttggatgcccctcctttaccagctctgcaaaaggcagaaagaattttaacaacgataggacttgttgatgagtccgacaagtcactcacacagctaggtcaatttattagcctgatgcctgtcatggatagtaagcatggtaaattgctaatatatggtattctgttcggctgtacggacatttctgttttacttgtctcgatactcggtgttggagttttgcctttcatcggaggttttgaaaatagggaaaagataaaaaaactgctatgtaaatatgaaagtcgtggggatttatttgcagtattggaaattgtcagagattacttcaaaatcaaagattcgagcatcaaaaggaaatatttgagagacaatttactttcctataataaaattaatgaaattaagtcatcaacagcccaatattattctattttgaaggatgtaggctttttaccaatggactataaagttggaagcatttctgatttgaataggaacgagcgaaattttgatatcctaagggccattctcacgggtgcgttttatccacacatagccagggtgcaactaccagatgtaaagtatctatcaacaagttccggtgctgttgaaaaagatcctgaagccaaaatgatcaaatactggattcgaagcgaagagtatcaagacaaattagaagaatataagacgaaaatttcgcaagagacgcaaaaggttgatttggaagatttaccgttacctgctactagggcattcattcatccaagttcagtcttattttcaaccaattcagtaaacttggaagacgctaagttactctctgaggtggatggtccaatatcccgtcaatccaaaataccaaccgttgtaaaatacccatttgttttgtttaccacgtctcaagttactaataagttgtatttgagggacttaaccccaactactacattatcattactattattcggaggggcaatctcttatgacattggaggtactattcattcaccgggcatcgttgtcgacaactggctcccaattagaacctggtgtaagaatggtgttttaatcaaggaactgagaacacaacttgatgaggccataaggaaaaagttagaaagtcccgattatgctaaaaaatctcaaattgataattctgatgctgataaaactctaaaaattgttgaaaaaattatagcttccgaacaatagtaatcagttcctactgtagtccctgtataataattatcatcttcattttcgaaaaggaatttttttaacatatagaagtgtcaaagtataaaacactaacaaaaatctaagagattattgcgactgcgtgtttttctctttgctgaatcagggctagaatcccgtaaactacatagcacattgtctttgccatattttaaaaattttgtggcgccgtcaaaataaaaaaaaaatactgaaggatgcgaggttcgaactcgcgcggacaaccgtccaacagatcttaagtctgccgccttagaccactcggccaacactccgtcgataatacaacaacaaggaaatacaggatacaaacagcatccagtttaacttgattaatctttacgcatgcatattgctacatcttttttattctgcaatatacatctgtttatatctcattaatgttggtaagcctctgaaaaatttatcaaatactagtacaatttgttggaataaaaatcaactatcatctactaactagtatttacgttactagtatattatcatatacggtgttagaagatgacgcaaatgattagaaatagtcatctaaattagtggaagctgaaacgcaaggattgataatgtaataggatcaatgaatattaaaatataaaatgatgataataatatttatagaattgtgtagaattgcagattcccttttatggattcctaaatcctcgaggagaacttctagtactttctacatacctaatattattgccttatttaaaatggaatcccaacaattatttcaaaattcacccactcttcacaattgtttaccaacatcattttcgttgctagaaaattactatacaccgttaagaaaagacataaatcatgagactaatagaacaacactagggattagccaatttaatgggagctgaaatgcagaaattaattatgcaattagaaaatgaatggtatcgtttgaaatgaaggaagaaacactaatattataacatagaaatatcgatttcttcctgcgaattcccatgtcctcgttgagaacttctagtatgttttgtatgcctaatattatagctttaaaaaaaaatagaatctcaacaattatcccacaattcactcatgtcatgctgcctctcgcgtattttttcttgaaaccgatgctagtttagttgtctttcggcatcagctctaattttttcaagaatagtatctacagagtcaaatttcatcattcggagaattccgatgaatcggcatcgtcagagaagctatataagaagagataaacacatttgaaagataggatatactttgaaagtgttctggtgaccactatatcacttaagtaatacctaacaaagcaatggtacaagaaatcgatttaggtttgacatgtgatatgcatgttcatgtaagagagggtgcgatgtgtgaactagtcacccccaagattagagatggtggggtttcaattgcttacatcatgccaaatttacaacctccaattaccacactagatagagtgattgaatacaaaaagacactgcagaaactagctcctaaaactaccttcttaatgagtttttatctttcaaaagacttaactccagatttaattcatgaagctgcccaacaacatgccattcgtggagtaaagtgttatccagcgggagtaacaacaaattcggctgctggggtggatccaaatgacttcagcgcattttacccaattttcaaggctatgcaagaagagaacctggtattaaatttgcatggggaaaaaccttctgtccatgatggagacaaagaacctattcatgtattgaatgcagaggaagcctttttgccagccttgaaaaaattgcataatgatttcccaaacctgaaaataattctggaacactgcactagcgagtcggcaataaagacaatcgaggatataaataagaacgtgaagaaagccactgacgtaaaagttgctgccacattaacggctcatcacttatttttaacaattgatgattgggctggaaatccggtaaatttttgcaaacctgttgcgaaacttccaaatgacaaaagggccctagtcaaagctgctgtatcagggaaaccatattttttctttggatctgattcagcacctcatcctgtacaaaataaggccaagtacgagggtgtttgcgcaggagtttactcacaatcttttgcgatcccttatatcgcccaagtttttgaagagcaaaatgccttggagaacttaaagggctttgtttccgacttcggaatttccttttatgaggttaaagatagcgaaatggcttcttcagataaggcaatattattcaaaaaagaacaagttatccctcaggttatcagcgatggcaaagacataagcatcatcccatttaaagcaggtgataaactaagttggtcggtgagatgggaacctcgttaatatgcaacaatatgtaggctcatttgagagtatagaccatatatacatatttatgggaaaaataaacttaccttccaatagaagttatagatgccatcatcatgcctattgttatggtccgtatctctttacagaagttcacagccaaatgcgttgatatggtatattttttctcttcagttttttatcaaaaaatgccacaaccttgatttaatcttgcatactaacatccacatcttgagctttttgcttttcgtcattgctttcttcctcatcactttcactactattattcagcactccaatcatcttattgtaaatttctttatctttcgcactcaattcatttaagggcaaattacctgagttcttctcttgcagccaaaagaagtacctttcgttggatgaaaaaactaaagcaaatattctgccacttttactggattttattggaacccacatggtctctccaggaattaaaatcaaagaaataggatcaagttccctcccgaccggcttttccgttggacgccactcgaaatcccaaaatcccaattcttcctcttcatttggtttgatctcgatttcaccctgaactggaattggcgtacatagacgtgaatcttcgttgtattcacaaacaccagccctgaatttaattacagttgaactcatactcatcaacactcttttaaaatttataagtcaaccagcacttaggtagttttctggcacccttatagaacctaatctactggtcatagtagagtatttagtagcaaagctttcgccacctcgcgaataatatatcacgaaatacggaggaattttaactgaaatatatcaataacgcatatcaaggaggggatgacttgatgagttgaaaataatataaatggttcaagcaaccgtttgtacaccactcagtcaattattgcttcaattgaaattatagaggaccgaagattagtcatataaaacaggggtctttttttctttagggagattactattacaatgtcgcaacaggattcacagcgctggctgcccacggatcggctaatatatggtgtgctagtcaaatctttccttcccttacaaaggtatcctgagctggtatatgaaaacagcaattatgcgaacgtttatgtgggtgcagaagtttacgtcttcgaagaatctgtggataagaaatggtgtagagcgtaccaatgtttacgaccctttcctgaagaattcatatcgaatatgaactcggcgaatgatgtactgccagacgtgaaaccgaaagtagtgatatttcctagaaaatatgttcattttgaagcagaaaaagccgtcagcacaatgccatttttcaaagcacctagtgctgaggattttaaaccattgataagtaaagaatgtgagtcccgctccttttgtgacagcctatatgttagctctactgatgatatatcaactggtaaaccaagaaagacaccgagacctccgttcccctttttcagataccaaaagaggtcctttaaggacgaaatgggtcctatattatctcttatttcctcgcatgtttactctatgtattcaattggcgagttttctatatataggaaaatgataaaactttattatgatttggacactatacgatttagattgtctatgaatttaaccacagaggctgagaaaataaatctgataagagcagcaacatccctaagaactaaaatcgcaaaatttttgtcctccacatacaggaagaataaactaattgctaactctactccaagaaacccagatccttatggtttcgaaggaatttttgccagggatattgatactggcgaattgctctcatacgagatcgacaaattaagaactttagtgtcatcgtcaatgctttgtggtttaactaataattttcctactgtacctgtggtagagtccgatgatgagtcctcatctaacggactattcggcacagttagatcgagcattttggttaacttgaaagatctggcatgggatccctctatatcagatcctaaatatcaagatctttctatttgtgtatacttgagaaccaaagacgaagttttaacagagtcttttaccatgacgaagtcgtccaatatggaatcagctctagatgaaattcctgcaatgttattcaagaatattttggaaacgatagtccataaaaataaagtatacttagtagtagtgctgaaggaaacaatagcaattacaacagaaactgctccggaaatttcatcttacaatatatctaccgaagagtcaagttcacattccccattttctccatttaattcatcgactgagaataagattgaccacgtaaaaaagggcttagctgccggagttattaacatatctccggtattcaagttttataacggcctatcagttgcgaataaagctcagaggtttaacctttatctttatagctccgattcctcggattcgcaaaacttcaactcttcaaaggatgcggatttaggttggggcgggttaataaataagataataaaagattcttctgaaggcgtttctgtgaaccctagggctgtttctttatcggtaactgtaaaggaaattataggcaaacaagaggcggaaaaagtgctctccacatctttagtaccgataagatctattcccacatacttttatgataccatgtttagccaagcagaaagaatttatctgaacttaggtagggtgtcgctttatggacttcctgcagctgatacaaatatagaaaatgttaccgttcaaatatcctgcaggaataaggccgtaaaattttgcaaaaataagctcgaagagagatctggggactggaagtttgtttcagttcgtccaaatgagagcataggcgaatcgattagaatagaaggggtagagaacatgaacgaagacgagacattaagagtattggtatatttgaatggatttttgatggcaaaatcaaatatacatatcaagaaaaagaacgaaatcatagaatatagaaagggtaccgtattccaaataatgtcatccaaatcagtacctctaattcatttagagcttgaagcatcatattttggtcggagatataatatcaaccctgccattacaaatttcttagttcttcaaaccaaaaatgttgaattcgaccagcaacttaaagagcactattcagttacattgaagcagctgaataacgtttcttttaaagatttactaaagcattttgacacaattttagcacactatttgttacttcttgaatcggtgaatgaagctactgataaaaaaggcccttcttcaagtttacccaatattgtattcagtgaattcgtcaagtttttaaatttaatgttaacacaccaagaaaactctagatattggtttaatagactgtacaaaaaagtcatgtcaaaggaactagaatgtcccaatgttgcaccgatactaataaaacatatgacaacgatctttgataggagtcattcttcttggactagaacaggaactgcaatctgccgaaccatcctgtacataattgtgttggcaatcggttcgtctcattctgatgaaatgcctaatttcagtcattttttcagaagcttgcacaaatttttaatgcttgctgatgagccaataatggcggatcaaattttgttaatagaaagtattccctctatgctggagacaatgaccaatcactgtaaggtggaagacttagttcgttttgcgatcggactgtttgaatgttgccaggaaaaagaaatgaatcaaaaaatgtactccaggccactctcagttcgagaagaagaatatttgaatacaaagtttaattgcctgttgaagttaattaacaagaaggttttgcaaaattatttaaccaatacggaatccgtagataaactgaggttacagtttttatctaaaacccttgagtggttacttacgccgtatactccaggcgatgacaaatgttttcacgtagaatccttacgcttggttaattctgttttcattacaataatcgaagattacaaatttgacatgctacaaaggaacttgataaggttactaccatatttgtgtaagtccttcgtccatttaagaaggtactgtaagaaagcacgtttaatgaggcctcgaagagtttttaccatgctttttcccagagaaattccatgcaactacataccggttgattcaatagtgaatgatgaagtagtcgtagaagttcttctagagcttgccatcataatttgtgaaataacgaaaattgcatcaagcagatttccatcatatcaatctttcagcgaaatcataaacttgtgcgataaagacactctttttcaatcaaatttttattcacgacaaatcacgaatgaaaatgtctatacaataaccaaaacagtttttttgttttttaaacaagattggttcccaggaatgaagtggcttggcgtatcagcgttattaggaagatcgtctctaatattgcttagtttatgcaaggattatatcatagaaaataattcaccttctccatcaaaggagtctgaaaagagggttgacatgcgactttgggcagaatatgtaaaagtcatactactagtttcaaaccataaaagtgcatccttgactaagttagctattactccacgtaaggccgtttatttgatatcgggtgacctgaaaaaaatttcagcatatatcctaaatgaatgttgggatgccctagccactgggcactataatatcacttatgctaaaaagtatggattaggagccttgagtgattgccaatttgaattgtttgttcataatcaatttttgatacgtgagatctttatttttgctttccatagacatatcgatgcaacaagaatttgttgcaaaatactatggggattagggctaaatttttggaggatatttgggtccctacaaccagcagtgaacgcatgtatcccagaattattcagcgcataccaaatcgggaagcttcgtttgaatgattacgaattggaaaggtttgtttcttgtttgttttttatgatgcacgttcccgattctgacaccttttttcctgcttgtatggatttcttaagagatttacttggttttttgcatattgtaaatgaaatctacaaaatacctaatcaagaagaatttgatgatgatcggactgctcggcacatagagatgttcgagtacttgctagaagcaaacaggccagagttgtttcataaaatgatatatgatttgtttatccactttattcagaaaaaagactttgttcaagcagctttgagtctagaactcttggcaggtacgtacgcttgggattctaatgatactcttgaagcaatatctttcccgccattgccagagcaatcttcatttgagaggaaggaatatcttcttaaggaatccgcaagaaacttttcgagaggccaaaaaccagaaaaagctttagcggtatacaaggacttgataaaagcctacgatgagatcaattatgatttaaacgggctggcctttgtacatgaccaaatagcaggcatttataccagattacagtccattgatagactggttccaacgtattttaaagtttctttcatgggatttggttttccaaaatcattaagaaataaatcgttcgtctttgagggtctcccatttgaacacattacgtctatgcatgacaggcttctacgaagctatcatgggtcaaatattgtacactcacaagaagaagtggatatgttattgatgaatcctccaatgggaaaatacattcatgtagcttccgtcgaaccgtgcttaagtatatccgataattacaacagtagtgacaagaaaagctcaattaacaacaaagtgcggatgtacattgagaatagagatttgaggactttcagtaattctcgacgtttgccaggcgcaaaaggagtcactgacctgtgggtggaggaatatacgtatcatactatgaatacttttccaacactaatgaatagatcagaaattgtaaaggttacgaagagcaaactttctccacttgaaaatgcaattcgttccttacaagttaaaatacaggagttatatgggcttgaaaacatgtgcaataaaactctgaaggaccacggtgatgtgaacgatttatttaccgagctttctacaaatattacgggaacaatatcagctccagttaatggaggcatatcacagtacaaggcctttttagaaccctccacatccaagcagttcagtactgatgatttaggaagattgacgctagcttttgatgagcttgttgcagtattaggtcgctgtctaacgttgcatgcagaactactaccatcaaaggatctaaaaccatcacatgatcttctagtgcgtctttttgaggaaaatttcgctgaggagatagaaagatatagtcgtactctcagtgaggccaatcgtagcaggaataacatgattactgctcgaataatttcgcacaagaaccccaataaaaaggcaagcttttctggaagggatcatcacacctcagggtccaatcatagccaatttgtattagaacatagcgactcatttggcccaaacagtttactttttggaaaatatttaacaagaacgttatcccactcgtccactacgagcagtttggataaaagtggaattgtttccggcacttcgagcacctttttggcagggtcacagccaaacaccaacacagattcacagcacaagcatgattactcacattcgggataatatgtcagaagttgttcactataaaatatacgcatatgtaatcatttatttattcattcatgacttttagttgaaaagggcacatttttctttgtcgtaaaagtgaagaagacagcgaattttttcctttctccttcaagtattgcttttttgataaagtatttttcgaaatattgatacaattattgaatctttgtaccgtatcctttttttccttttttctaaggattcttcacgttgtaatttaaagtgtacagggaagaaaaatcgtcaattttaccgggccagattgtctcaggaagataagttccattttccgctataaaattctgacgttcttcctggtcctgagcatctaaattctgcaactgcttttcacaatctttcaatatagttttcattctgtttgccacatcctttctcctctttgcttctagaactaagttaccgtagctttcttcaaaattatcataaaattcacaaagttccttagttgtttgaatatcttgtgtacaggaatttttgaagctatcaatcagattggaaatatctttaaagattaatagatattccaaatttctattgaaatcgtttattatttcagaaacttcgctgtgtagttctgtcttttcctttatttttgcctgcaaaaattgacccaagttaagaattgttttgtccacgtcatcaattacctcatgcagagttttgaaaatgttgtatagttctttgtcgtcgccttgtaccaccttaaacagctcctcacgttcatcgttatcaatttttttatcttgtaacagcaatgtcttatcaaagtgctgtgtcaatgaattcattatctctgctaaatctttttcaaggtccgttagttccctgctaaactgctctgcaacatttgtttccatcaggttatctataccaaatttactttggaatttttgagttacgtccgtcaacttggtatcaatcagttctttgttaacttttctgaccatattttcgtattgaagcttaatgttttcaatttgacgctcaattactggcacttctttcagtttgtcattcaataagttaacgttgtctctcgagatgtaatctcctagtttagagggatcggtatcatctttttctgatatgctcaattcatttactataccatccaacctttgtactttagaagtgatttcatattgccagtacttcatctcatcaactaagaccactaagacagcttgattccattgtttctggattagctttgtcccaatgccttcctttaaaatagtgtaaagaaactttccttgctgtctcaagccaactattagaaaattgagttttgaaatactcaactgccaagatgacaattttttcttaatatctacaatccttaaattagcacttgaacataaaagttgagcatcggtcagcgttttcctggcattattaacaaattttgtaacatctgcttcgttcataggtgttaaatacgttgataatatcctcgcagtatcgaatttatcgtacgttatgcgactttcaaataattatcaagttagggatatcttgcaatttttaatactgaggccttagagcgcgcatctagtatttacattatgtcaaaacaataacaaaaatccaaaatttcgaaatagtacaaccgagagaggtcgaagaacttaagccttcagtacgccaaaacatggaggattcggactccaacacagataaaaagttctttttcaaaaaaagaagaatcgattcctataattatagcgatgaggaagataataattcaagcatgaatagtgacatgacatacactaatgatgccttgaaaactagtagcggcaatgccccaacgatctcaaaattaacgaagacatatggtattggtgcgaagttactttcgagtatgggatatgttgcgggaaaaggccttgggaaggatggttctggtataactacaccaatagaaacccaaagccgacctatgcacaatgcaggtctaggaatgttttcaaataccaactccagtaactatcacagtgaaaatgaggattacttgagctctgaggatgaggtggttgaaggtatagaacaagtcaaattcaataaaacctccacggaggttttaggcgaagcgttgttaaatgatagtggtgatatgactatagtgcgaacactgagagaattgaggttagcaggggtacaattaccagagagtatcctaaaagaattagaccctttaaatgcagtaccaaagccgaaaaaagatgttgttgtggagatattgcaagagctgctgggtattgaaaaaagtttggaagctattcgtcagcgcacctctccgttagaagtgcaagtcaaagaatattatggacaagagaggcttctttctgaattggaggttactttgagggacgaaagcaagcatgtttccctgtatgataagattggtgctattttaaaattgtccgacgacgagctcatagataggctaacgtcctgcttattgagaaaagaattactaatagaatttgatttggatcatttagaaaagccaaacgatatacttgatgagttaacgcaaattatagaactactcgcatatagaatggatacaacttcgaaatttttgaacaggacacaaacaacaatctttaaagttatatatcccaaactcaaaaaattttgggaagggtttgatatgactaaatcaaaaatcgacagcgctatcaccctattactggatttccaacaagtgctaagttttatcgggtgtaaagagcatatcatggaggaattcgtctatccaaagctattacaggaattagataattgggaacttcacgatgaagtagaccatgtttcgccaagaatatgggtcttggattttatggttttaattgacgataagatcaaagacacaattgtggacaagattgaagcaaaattttttgcttattgtaaaaattggtaccatagggaatcattttgtatcactaattctgatattatatttatcaaagaacttatctgcgaacgaagatattacaaaattttatgtaaagagtttcttcctaaattcctggacgagctgtgggaaagacataatgaccccatctacgagttagaggattggaaggaaaaacaggaatggaaagaaaaagattctggatttttctattttatgaaaaaactgagaagttatacccattattttcatccaaaacagtatgaattgatgatgcggggaacctttaataatataaacaaaatactctatcaatggcatctttatagtacagtggaagacttacacaagtcaaagtggtggcttaattggctgatgaatacggtatttgagcactctttaccaacagaaatagaactatcggagatcagaaaaagctataatatattcgctatgtctcataggtaccaccttgataaatctacattagatgaagatttcgatttgagacagggtttacgaaacttaatggaaacacaagtgatcgacgatattagtcaaagcgaacaagaacctacctatactgtacaaaatattccgcttggaaaagttagcagctctttcaaggatgtggtagaagactactgcctggaaaaagggtacttgatcagcaaaataccaaataggtacactcaactgccatatggaagagaccaagattgtatagttcctttatttgagatccgaaacgggaagaaaaaaatggaagttgctttgaaacatgatattctttgggtggaggattccagtgggacctttaagccaatttatttatgggcccttgacctctagaaagtacctataaaagaggtgagataggcacgatttatatattattgtcgaaaaacaaaattgattagattactaaataaataataattgcattaccatttttagacaatggattaatttaaagtggagtctattaattccccttatttgatagttgttggtattttgcccttgaaatgtttccaaaatttattgtttaaacttttatacttcgctagactctcgtagttagactgttaagagttgtggcagaaggaaacgagtttcggatgggatcaaaggaccttttttatatcaagatcaaatggagctgttattttccaagaaagacagaagaaagcccgaatgtggctaagtagtgagcctaatcaagtagtcagcttcacttgatattagtttatacgattactattttaatggagtttttagctcactaaataatttaatgcaaaaaaaataaacgaccccagtgagggttgaactcacgatcttgcgattaacagtcgcacgccttaaccaacttggccatggagtcttttatttccgatatctgctgagttaaaaattatataatattattgatagcttctatcattgaccttcaattacttatgttggaatatcaaaaatgtgagatttttttttcaaatagttttgaagaatcagcgaataatttgatactttttgggattcttgttagtaacggctattgttggagttaaacttctttaaatttgtagagtatgtggattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaggttcacacgaagattgaaagtgtggccacgctaatttagtttattagggaaatgctcctggtcagttctaattcacccaacgtagcgcggaatattttaaagttaatatagtatttcgatatgacaagcacctctaaacaaaaggttattttcgcttttgttcattgagcgtgtacttcaagcctgatcctgctttttcttctgatttgatctgattcgattaagcaagcggtactaccctaaaaccgccatctgttgtaatatagtaacgtcgcaataaacctgtcatataattagcagctaatccttatattccatctcctcaatttgtgatatttatcgtatataattcccatttcagaccgtcatttagtagtaggcatctaactatggaacggctttacccgatcttggtatgtatgccataatgtactaccgctatcgatttaccttaaccctaacgagtgtctctagccagtattttaaacttccatatcacaactaatgttgaagattgtataataaaaacatcaagctatttaatagatgcgattaatctcctaatcgaaaacagtttgttcggtgtccaaatactgttttagtggactatgataaacgttataacagctattttgactaaaacaaccgtaaatttacacagataggtgttcacagtaattttttggggagttaggtcgaaatcttttccaaaaccagtcatgcaaaggaaatgcgtcaacttttggggacttttcccctactcaaacacagttagtcaacatttaaaggttgtgtctttacttaagagaaaattaactgagcttcggtcatacatacgtaatttcgctgcttccagtcgagcagttggtgcgctataatcatttgatgtttttagcttacggcttcttaagattttctattgttcatactgactcgtcgcataggccgcaatataaatcatttagagaaaacgttaacacatcgtttaggtaaacaacccctagagaggatgatcagtacgcaatataactgttcaaaatccatttcttgcatcaatattttattcaactattatttctggaggttttagtggttctgtataccccctccagccactgttatgaacaattaattgatactacttcgaatataaacattaaaacaaaaaacttattgagtgcagcaagttaacatgtatcgatataatagaagttccccttttgaacgaacaccagaaaaacgagtaagccgtcaagaaagccaacgaaagagcatcgaattgcccaaactgccaccattgaatacgaggaactcctttttggatgattctgataacggaacagataatatctcaattggctggacaccaatcagtgacacccagcaattccaaagcccggtccctcaggcttttacctttacatcaaaacatagtgcaaggggaaacggtactagctcttcagaatccacacccaaatcgacaaagtacgtcaaagaaagacgaccaccaccaccgccaccccttttgtattccactgaatcaatacggatagactcacccatggtatctcccagttctcagtcccgggaaagatcacctaataaactatcctttataggaaactcagaggaacgacatcacatggaatacatatctaaccattccaggatcttaaaatcaccatttgcgaacggatttagtccaaattcccctaaatctccaagagatagtagcaaacagcaggctcacttctctgatgaatcagatctacggtgtcatgaaagagaaaaagctttacccccaattcctttcactactactcttctgctatctccttttgatgatgaagactcagaattttttacgaaaccaccaccgcctctatcaacatctagaaacgtaagtgggaatagccgagtatcagaagccctagaaagtgtttattctgactcagattatacttttaataactcaaatgccaggcaaagtagttttaactctttactaggagccaagccattagaattagcaccaagcattactgcaccgacacaaccattttcaattcaatctatcgatgagcacaagctttatcaatgtgataatgtttacaaactttctgctatttatgagtggattttgaaagtttattttgaatggtttaatgaatgtgtcttcacgaaaatcgatcttttccaaattgttcaattacttttagagtttcaaatgcctacaaatttcgatcaagatacgatagactcaaatgtggataatattatggcttcgtttatttcccagaaagcagtaagattcgatatcattaacgatgaagaggtagccgtagttgtgggagggctggatattactggtgttttcaccgaactactaccgtgctattcattcatcgataatacttatggatctacaaactccctgatttgttattccaacgtttgcacacatggccaaagctctggcttcagaaaagaaataaaactttccgaaatcataaataaatcagttggactttggacagaatactggcacttgactccagatgatttagcagaaattaatccccgtgaagtacaaagacaaagctttatatttgacttaattattttagaagaaagatccttaaacatggctactgccgcggtagaaatctatgggaaacggtttgacaaatccctacttccagatgagcctgagttcaaggcattggcatttgatatcttcgaacctctaatacaattacataccgaatttcttttgacgccaatattttggaaattaaaaacgagaggtaagtttattgatggcgttggaaaaatctattcaaaatggtgtggtgaagccaagaatatatatttgaattacgcgaaagctatggcaacggtacacgaaatcataatgtgggagaagaaaaacaagacgaaatttgtaacatggcttaaggagattgataactcggttgaaattacaagatcgaagatgtatcatgatgttatattctttggggggtttttcaaatctttacaaaacatgcccgtaactctgcgctcaattttgaagaacacggatccttccatggaggattatgaatacctgaaaatagtaattaaggaagtagaaaagttgaactttgaagttaatcaggtacatggattagcaattgaccataggaaactagtaaggttttcgaaacaattagtattaagtactaatagtagtaatgcaacaagctatgtgaacgtcggtggtagtactaacgcaaatgacgatgatgcaattcaggataaactagctcttggtttaacttatccggaaaggaagttagtactatctggcactgtttataaaaagagggatttatggctggacccaaccccagtgtatatcgcattattggacaattgcttactgattacagaggaaataagtaaaggagaaactcaaaaatataagcttattgaaagacctatcccaatagattatttaagtctcgagaaaaggaaaattccaggaacaagtaaacagcctctgagaaactactctcagaaagaacataaatccccaatgcataatttttcgacaccgattaactccatgagacctctgcttaaaagttctggaaatcacatgtcaacagcgtatggagatagaaagactagtaatactgaaatttctaacgcgaatccaaacacagacgagttctcatttaagatcagaaatacagccacaggtgaatcgttcaaattttttacagaaagtgcagaagtactcaaccaatggattgatgctatcatggaatcttttaaaagaaatgcagaaaatcatgatttaaatgcctttgaatttacagtgttgagctctgagttcgcatacttcgacaaggatgcaccggtgaatctacctgtagctccggaaggatcagaaattgatgtagcactcaaagcttacgctcaaaaagcaaacaaagattcatgttcatggagtaagacaacacggattctttgttgtgaagatgttaaattcgagggcagaatttacctatttgtggctacaacagacggtatctatgtgaaatatagagacgattatggtagtggtttcgttaaaatattagaattaaacgacgtcaaaagaatggaagccaatgttaagttggggctcttgtttgtattggataacagaaagttgtgctattttaatatctcaacggtagtgagccgttacctagcgcaaggaaacactctagatgaaaactgcattgtgggaacagtaatcagagataaggtgagattcttcaaaattgctgatgattttggtaactcaaaacattttatttttgaaagaaagggaagatagttatattaacaccagaatttnnnnnnnnnnaattgacaaaccaagtaaaatatttcaaattttacaaagagtataagctcccaagttcaagtaataacattctgaataacgaaattgaggatattgccatattcaggaaaagttttgctgtgtgtacaaagaaaacagtcatactttatcaagattcattcgaggataacggaatagtcttaccatcttttttgaatgataaagatatgatggcacacttgaggcatccacatttgaatagcttaccgttcaaaagtgctacagactccaagaaacgcccctccatagaatctctcactgaagaagcaaaaaaggatatcgccacttgcaaagctataccggtcaatttttttcaaatatcacaatctagtttttttgccttggtttatgatgaagccgtagtgaaaataaactgctacggtgagatgtctgattggagaaaggatattctcttacttgatttttgttgtaccggcgcgagcttccatggtaatcatttgattctcgttggcgacaatttgatacagatttacgacttaaaaaatgttgagcagaacctaggcgaattggttcccgtccagatcataaaaggaaagaagataaagctggctagttcagaaaggagagagaaaacaattcttgtgttaagtcatccaaatatacttaatagacaattattagtcgcgtgcaatcctgtagcaatggcagatcatcaataatataagatatagacacttttaatggtaaatatcgttgtaataatataagccaacaagaatatagtccagtaattatgctatttgcagtaactcacatcattattctctctgttcatataatcctgaataacaggttaccctcggaagtgcatttagccgtataacaagtagctctttaaaatcagtagaacagatacattaatatgtgataatacggctgtgaggaaaaggtgaagttctggtgatgaatatagactgtttgtgtcgttgggtagttctgccactgctgcgctatccacttctggtagctcttgtattgagatggtatgtaaagtagaaaataggcatgaggttagaaacagcgttttttatactaacatgacgaactaacctaggtctctaagcgactcgataagcatttgtctaacaatctatacactactgataaatgcattcctcattgctaattcctatataaagcggtcgggacaggtcgcctggaagagccttcgtgaatttaagaatggcatagttcttattactggaggaagtaaaggacttggacgggccatagtatctcaactcctacaagactacagcaacctgaccatcttgaatgtcgacatatgcccatcatcagtgaggaatactcgcgtgaaggatctcatctgcgacctgagtgatgatgaagaagttgcagcactactgaatttgttgaaaagaaagtataaaaatgaaatccgattgattgtgaacaatgctggagtaagggccaacttcaccggattcaacggcatggaacgggataatcttgataagatttttaagataaacacatttgcaccacttcagttcattcaagaactggcccctagtagacactcaactagacagtgttatattgtcaatatcgcaagcattttgggcatattgacgccggccaaagtagcagcttatgcggcgagcaaagcagcattgatagcctttcatcagtcgtacagttttgaattgcaaaacgaaggcgtaagaaatatcagaacactattagtgaccccagggcaactgaatacggaaatgtttgcaggattcaagcctcctcgccagttctttgcccctgtaatagacattactactctagctgccaagatagtccgttattgtgagctgggtcagaggggacagctaaatgaacccttttattgtagttttgctcatcttttgatgtgcgtaccttattcgctacaacgcattgtaagaagcttctctcgcatagattgctgcctcccggacgagtagaaagctatacatagtaaatagaatatttatagatgaatccgagtagacagccttggtgtttgcttatacattctttgcaattatgcacgccctcattaccgttgctcatatttttgggcattaattgtattttgaaaagtgctcgttcaggcccgtgtaaaaaaaggtgatgaagcaaacattataataaacacttctgagaagccacgtgtagaggggtaagctatatcgtaaacaccgttggatgtggaccacggtgcactgataaaataaagatatagtagtagaatctgttactaatcttaacacttttgatggtagaaccggacatgcagaagaaggcaagtggtggcagtggcggttccgagatggatactttaaatgctaccagcaacagtagtaaacaaggagtttcaaataataaaaggaatccggtcagtaaaaagaaaccagggaataaggtctctgatggaagagataatgcacataattatcacggggaaggccgcagaaaaagtagcaaacaacagaggtcaagaacgccctataaggagactagtactaggatcaatgatcaagatatagatttatctatccaggaagaaattcttggtggtaatttcaaattacgaggcaggaaaactcaagtttccattaatcatttgttgaatttccagttacctgaagtcgaaagggaaaaaagtaggtcctcttcaagtaagaaatcgaataggagacgcgatgagcacgtacatttacacggtgacacatttgttaatgttaattaccgtcttttggtagatgatcgttttgactacccagagcaaaactgtaacccgaacgttcctgtcgatcaagaaaagattctaagagtcatagtgccaaagggtcagaattgttctatttgtctgagcgaggaaccggtggctcccagaatggttacttgtggccatattttctgtctaagttgtctcttgaactttttctccattgaagaaaccgtcaaaaataaagagactgggtactcaaagaagaagaaatataaagaatgcccgctttgtggaagtattattggccctaaaagggtcaagcctgttctgtatgaggacgactttgatgtaaccaggttaaatcaaaaacccgaacctggtgccacagtacatctacaactgatgtgtaaaccacacggttcactattacctttgccagtagccttacatttagaccctctaaaatgtggaaatttccctcccgcaaacttaggatcaataaagcattatgcgcatattatgaagtgtggcgtgtcttactccttggagctctatcaaaaggacattgttgctattcaggaacaatatgaaatcgacaaggccatttataatgatagtggaaaatttgttaagcagtcgattgaaaatatcaatgatcaaatttcgacgttgctggctgcaaccactgatttgagcccactttccaacgatattaacaacggtttggacaattttcattttgatgacgatctcttgaccaaatacgatgattcttccgcttattttttctaccagacgttggtggcatcgtccacgaaatacttcttatctccactggatgtaaaaatcttattgactattttccactattattccaagtttccagaaagcatcgagacgacagtcgaaaatatacattatgatacagtggtaacggagcaattaatccgccgctacaagtacatcggccaccttccaatcggcactgagattgcccttttagacttggactggcgtaaaataccattccttcccaaggaaatttacgaacagtttgctcatgagctaaaacaacgtcgaagaaaattcacaatgaaaaagcaaaaggaagataaggaaaagaaactatatgaaaaaaggttggaacaagaacatgccgagttctacagaaaggaaaatggcaattctctcaagtttgaagactctgtacagatggctacccattatgaatccattgtaagctcttccatacctctcaactccttaggaatttctatgctgggtccaccgacaaattcctgctctactcctcaaaagcaagcgccctcccacacgaaaagaacaatttgggggacatcaattgcagtgacggaagacgaaaaagcatcaaaggagaacaaagaatttcaagatatgttattgcagcgaataaggcaggaagatagttcggatgtcacagattcgacggattctcctcctacaagtaatggtaagcgaggcaggaagaagaaaggtaaagtcatgctattcagcagcaatcatcaagccttgggttaggttacagcatgttctgcttaaaaatctctttccaagccagaaatgtgggaggacctattctatatcatttcaaaatcgaactctatatctttatgtataacttcaaacgctattgcatataaacaattactcatatatagtccaaatgcattcataccatgttatactattcaattctagtgtcgttgtgcgtgatttttcacttttgaccgtaaatagaatttcggtgatattattttaactctcgaagaaaataaagtagattcatgtacacgtatatcaaaagagtacagtgaaaaagggataaaggatacactccacttagaagggcgcaagatgagtggaaaatttgttcgtgcttctaaatatagacacgtctttggccaagcggccaaaaaggaactgcaatatgaaaaactcaaagtgaccaacaacgcatgggactccaacttgctaaaaacgaatggtaaatttattgcggtgaattggaatgcctctggaggtggtgcattcgctgtcattccgatcgaggaagtgggcaaggctccagatcaagtgcctttgttcagaggccacactgcgcaggtcttggataccgattttgatccgtttaatgaccacaggattgcttccggttccgatgattctaagattggtatttgggacataccggaaaactacaaatttcacgatcatgtagatgaagatggagagccaattgatatcaaaccagtaaagtttttgacaggacacgcaaggaaagttggacatgttctttatcatcccgtcgctgagaatgtattagcatcctcttcaggtgactatactgttaaattatggaatgtggaaactggaaaggacatgattactttgaaacatccagatatggtcacatccatgtcattttcgtatgatggtaattatcttgccacagtggctcgagataagaaactacgagtctggaatatcagagaagaaaaaattgttagcgaagggcctgcccatacgggtgcaaaaaaccaaagggtggtatggttaggaaactctgacagattggctactactggtttttcaaaattgagtgatcgtcaaatcggtatttgggatgccttcaacattgaaaagggagatttgggaggcttctacactgtcgaccaatcatcaggtattttgatgcccttttatgacgaagggaataagattctttacttggtggggaaaggtgatggtaatattcgatactacgaatttcaaaacgacgagctgtttgagttgtctgaattccaatccacagaagcacagagaggctttgctgtagcgcctaagcgaatggtgaacgtcaaagaaaacgaagtcttaaaaggtttcaagactgtcgttgatcagcgtatcgaaccggtatctttctttgttccaaggagatcagaggagttccaagaagatatctacccggatgcaccttccaataagccagctttaactgctgaagagtggttttctggcaagtctgttgaaggtccaattctcgttagtatgagatctatctatgacggttccgcaccaagctttcatgaggctaaaagacctcaacagccaacaactcaagaaacagctcttgaagagaaaaaggagcagcctaaagtggagaagccaatcagcgaatccgaaaaggaggtgaaacaagaagctccaaaatctccctcaccgctaaagtcggcctcctcatcttctacaatcaaccatgtattaaaggaagataattcgatcaacaagttgttgaagaaatcctccgatattgatcaagttaacaacgccgaagatccgtctagggatacctccggatgggaagaagccgatgatgagccagctcctatcaaaatcgaaaccccagtcactccaacagaaactaaaaaggatcgcacacctaaggtcgaaccttcaaaagaattgaagccagagccagtgtctatcgcaacagatagaaaacaggagcaaagcttacctcaagaagagaagtcctctgagaaaacaaagtcccctgagcaggaaaaatccgcaacacctccttcttcaattacggctgctaagacagccattactgccagcagtaaggaagagccatccgcggcaaggacatcacctaagtcattgggtttaaaaaagtctgtcgaaaaactatctacattggttctgcaattagaagatgtagttgataaattaacgaaagcaaatcttgacaaagatgagcgcctgttaaagttggaacaaaaaattggcgaactgtcaaaatgaaaattttttgtacttttaatgataaaattaagtgagtcctttttataggaaagatgtattttgattatatgtaatgtacataagacggcggcgataataatgcacttagaaagtgaatcatgttcacctgtccactaacaaaaaaggaaacaaaatgttgctttcccacaggaaaaagaatgtttttgacaaaacactaagcgttatgtgaccaatgtataattgtcctcatcatatagttttatgcaagcataaataagtctttcttttagttaaaacgcgttacatagtaaaggtaaccctgaatgaatttttatttatatttttcttcgcatattttaggatcttgaaaaattaaccacaagttagaagttgatgagatcaggaattctaacaaaaggtcattggttaggtttattttgtaggtgcacgtttgcaactttattccttttgtttcaaagttatagagctttcattttctcattcttctctagtgtaggtcatttctcctgcatattaacctactagaaaagtttacgaagcttcataggaacgaataatcgatcactttaaaggcttcccgcactttaatcttatcatctacacctacaaaaaagctctactttgtcatttattttctacttcatctctgtatggcatctatctctatatatataaaaaagcgcatctgtttattataaatgaattccaacaatcctgataataataatagcaacaacattaataataataataaggataaggatattgcccccaatagcgatgttcagctagctaccgtctataccaaggcaaagtcttacattcctcagattgaacaagtttatcaaggcacaaatccaaatattcaagaggcaaaattattaggggagttattacaagttctagcagaagttcccaagggtacgcatttattttgcgaccccatacttgaaccaatatcaattttttccctaaccattttctcattcaatgaagaagctacggccacatggctgaagaatcattttaatccaattctctctgtttgtgataaatgcattctaaattttgcgagagggaagtgcaaaatgttacaacattttgccattcaaagacatgtgccgcatgaacatgtagccaagtttaatgacatcgtatgccaatggagggtggaggctgtttttcctattcttagaaatatttccgttaacgataatacgggaattaacattacaaatgaaattgaaactgcaatgtacgagtgtctctgtaatccgcatatgttgaggcttaacaagcaacttaaggctactttcgaagcaatcttcaaatttttctacgacacaaagcatcgtttgttggacgttacgaatccattaagcataaaaacctttatatcaggtgtcatattttgctggtgtgaaggttcaaaagaggaaaatgagtggtcacgagcttttctaaaggatttatactcaagaaatttccatataaatctttctaacctgacaccggatattattgaggaagtttatatccatattttattcttacagaatccggcaaactggacagagattgtggtatctcaattctggtcgagattactaccggttttcaatttatttgataaagacgtcttcatagagtactttcaggtcccaaaaaatgtggaatctttaaaaaaaacattcaaatttccgttagagccaatttttaaaatgtggtacaatcacttaagcaaatcatatcatgataagccactagactttttgttaagaggattaacaatgttcttgaataaatttggctccgagttttggtccaaaattgaacccttcacattccatagcattttggatataattttcaatagagattcattcccaatcaaactaatcaaaattcaagacaatccaattgttgagcatcaaacagaagtttactttcaacttaccggttctgtaaccgatttactttcttggaccttaccattttatcatgcactgtcaccatccaaaagaattcaaatggttagaaaggtctcaatggcgttcctgcgtataatagccaattatccatccctaaaatccattcccaaagcttgtttaatgaattcagcaactgccttgttgagggctgtgttgactattaaggaaaatgaaagggcaatgctttataagaatgatgaatttgaaacagtactgttgactaaaacagattctagagctttgctcaacaatcctttgatccaagacataataattagatcagcttcgaatcctaacgacttttatcctgggctaggtgctgcttctgcatcggtggccacatccacgatgatggtattggcagaatgtatcgattttgatatactgttattatgtcatcgaacgtttaagctttattcaggtaaaccaattagcgaaattccaatttcaaccaacgtcttggaaaatgttacaaataaaattgacctgagatcttttcatgacggtccattgctggccaaacagctgctagtatctttaaaaaatattaatggtcttttgatagtaccgtcaaatactgccgtagctgaggcacacaacgcattgaatcagaagtttttgctgctatcaacgagattaatggaaaaatttgcggatattttgcccggtcaactgtctaaaatccttgcggatgaagatgcatcgcagggtttttggtcctgcatattctcctctgataaacacttgtatcaagcagctactaatattttatacaatacatttgacgttgagggtagactggaaggtatcttagcgattctgaatagtaatttgaccgttaacttgaagaatataaacgtgatgctacaaagattaatcaattgtgaattctatgagccttgcccccgtgctgttcgtgttttgatggacgtagtgagtgcatttgtagacccgatttctggtgtgtttgctaatttccaaactttgaagagccaaaataccgaaaaggaatttttaaaattctgggaatcatgttggttattcttggatacgatttataagtttactttgaaatgggcttctaaatatgactattctgaactggaaaatttcaccaaagatactttagatctaagtcgctctttggtggactcctttagagaattttcagatattcttcatgaccaaacgaaaaatttacttctcaacgttttagaaacctttaagaatatgttgtattggctgagattgagcgacgaagtacttttggaatcttgtgttagattaattataagcacgtctgatttagcacatgaaaagcatgtgaaagtggatgattccttggtagaaatgatggccaagtacgcctcgaaggcaaagagattttcaaataagttgacggagcaacaggcgagtgagattctacaaaaggctaaaatattcaataaagcactcacggaagaggtcgctacagaagctgaaaactacagaaaagaaaaggaattatcaagacttgggaaggtgatcgacttaacggattctgtgccggcgtcaccatccctctcgccctctctgtcttcaaccattgctagttcttctgctgaatccagggcagactatttacaaagaaaagctttatcttcttcaataactgggagaccaagagtagctcagcctaaaataacatcttttggtacgttccaatcatcagctaatgctaaactgcatcgtacaaaacctgttaagcctttatccaaaatggaattagctaggatgcaattattaaacaacagagttgttcatccacctagtgcgccagctttccatacaaagagtaggggtttgtctaacaaaaacgacgatagcagtagtgaggagagtgacaacgatatagaaagcgctcgggagctttttgctattgctaaggcaaaaggcaaaggaatacaaactgtcgatattaatggtaaggttgtcaagagacaaactgcggctgaattggctaaacaggagttagaacatatgagaaagagattaaatgttgatatgaaccctctatatgaaatcatattgcaatgggattacaccagaaatagtgaatatcctgatgatgagcctattggtaattattctgacgtaaaggatttcttcaactctcctgctgactaccaaaaagtcatgaagcctttactacttctagaatcttggcaaggtctatgttcttcacgtgatagagaggactataaacctttcagtattattgtaggaaatcgaactgctgtgtcagatttctatgatgtgtatgcctctgtcgctaaacaagtcatacaggattgtggtatttctgaatctgacttaattgtaatggcttatttacccgattttcgaccagacaaaaggttgtccagtgatgatttcaagaaagcacaacatacatgtttagcaaaggtgagaacattgaaaaataccaaaggtggtaatgttgatgtcacattacgaattcatagaaatcattctttcagtaaatttttgacactaagatcagagatatattgtgtgaaggttatgcaaatgacgactattgaaagagagtattcaacactggaagggctggaatactatgacttagttggccaaattctacaggctaaaccatcgcctcccgtaaatgtggatgcggcagaaattgaaacagttaagaaaagctataagctcaatacgtcgcaggctgaggccatcgttaattcggtatctaaagaaggtttttctttaattcagggtccacctggtacgggtaaaacaaagactatactgggtattattggttactttttgtctacaaagaatgcctcatcttcaaatgtcatcaaagtgccactagaaaagaactcatcgaatactgaacaactgttaaaaaagcaaaaaattctaatctgtgcccccagtaatgccgctgtggacgaaatctgcctcagactgaagagtggagtgtatgacaagcaggggcatcaatttaaacctcaattggtccgtgtaggtaggtcagacgttgtaaacgttgcaattaaggaccttactttagaagaacttgtggataaaaggataggtgaaaggaattacgaaatcagaacagatccggaactagaacgtaaatttaataatgctgtgactaaaagaagagaattgagaggaaaattagactctgagagtggtaatccagaaagtccaatgtcaaccgaagatatcagtaaattacaacttaagattagggagctaagtaaaataatcaatgaacttggccgtgatagggacgaaatgcgtgagaagaattccgtaaattataggaatagggatttggatagaaggaatgcacaggcccatatcttggcggttagtgacatcatatgttcgactttatctggttcagcccatgatgtactcgcaacaatgggtattaaatttgatacggtcattatagatgaagcatgtcaatgtaccgaactttcttcaattattcctctcaggtatggagggaagcgttgtattatggttggtgatcctaaccaactaccaccaactgttctttcaggtgcagcaagcaattttaaatacaatcagtcactgttcgttagaatggagaaaaatagctccccatacttgctggatgttcaataccgtatgcatccttccatcagtaaattcccctcttctgaattttatcagggacgactaaaagacggccctggtatggatatcttgaacaaaagaccctggcaccagcttgagccattagctccctacaaattttttgacatcattagtggtaggcaagaacaaaatgcgaagactatgtcttatacaaatatggaggaaatacgtgttgccattgagttagttgactaccttttcagaaaattcgataataaaattgatttcacgggaaaaatcggtataatttcaccttatagagagcaaatgcaaaaaatgcgtaaagagtttgcccgctattttggaggcatgatcaacaaatcaatcgatttcaatacaatcgacggtttccaaggtcaagaaaaagaaatcatcttgatatcgtgtgtccgtgccgatgatacgaaatctagtgtcggttttttaaaggactttcgtcgtatgaatgtggctctgactagagccaagacaagtatttgggttttgggacatcaaaggtctctggctaaaagcaagttatggagagatttgattgaagatgcaaaagatagaagttgtcttgcatatgcttgctcgggtttcctggatcccagaaataatagagctcaaagtattttaagaaagttcaatgtacccgtaccatcagagcaagaagatgattataagctacccatggaatatattacgcaaggccccgatgaggtaaaatccaataaggacacaaagaagagaagagttgtcgatgaaggtgaagaggcagataaagctgtaaagaaaaagaagaaagagaagaagaaggaaaagaaaaagtccaaggcagatgataagaaaaagaataacaagaaggcagaatcgcccagcacctcatctggtacaaagaaaaagtcatccatttttggtggaatgagtgtaccgagtgccgtagttcctaaaacttttcctgatgtggacagcaacaaaaaggcagcagcagttgttggtaaaaagaaaaataacaaacacgtttgtttttcggatgatgttagtttcataccaagaaatgacgaacctgaaattaaagtgaccagaagtttatcctctgtattgaaggaaaagcagttaggtttgaaggagacgagaacaatttctccgcctgaaatcagtaataatgaggatgatgatgacgaagatgattatacgccgtcaatctccgattcttcattaatgaaaagtgaagcaaatggtcgtaacaacagggtggcttctcataaccaaaatttcagcgctagtatatacgacgatccacaagtttcgcaagcaaagcagacgcaggtacctgctgctattacaaaacacagaagttcaaatagtgttttatccggtggttcttcgaggatcctgactgcttccgattacggtgaacccaatcaaaatggacagaatggagcaaataggaccctctctcaacatgtgggtaatgcgaatcaatactcaacggctcctgtgggtacaggcgaactgcatgaaactctgcccgcccatccgcaagacagctatcctgctgaggcagaagatccatatgatttaaacccccatccgcaaccacaatcttcagcattcaaaggacctggtagtgggcccacaggcacacgcaacagttcgagacggaatgcttcatctagcccatttatcccaaaaaaaagaaagcctagatcatgatcttgaagtaaaagtgttaggaattatacctgcatatatattggtgtatacatttatattgaatttaatagcaacattatttttcattatttttcattatttcagcaaaaagaacattttttttcaatttgacgtgaaagagtttgactattacgtgggcatacaatgtttaaatttacattatcctcatggctactctagctatttgcatttcattcaactttttttgatatggcatcatttttattagcgtttactacactttcagaaatgccaatctttggtggcgatttgctagcaaccaagaatgagggagtcgagggctgttttaaatttgaactcgcgttcgaccctttatggcttttgtgtatatcaattggtttagaaggtagtgcgcttgacccatcttgtgcagtggtactttcgctatggagttcttcacaagctttcgaaagtacgtccctttcgtttgatattaaagttgtcgtgagcttttcatcagaagagtcaagaaggttatttaggtactgtattgtagaattgatcatttctgacatttcatttggaggtattttggagttgctgctgctccgaagtttggttattaatttgctttccaaatctcctacttttttttgacaatctagccataattcacgttgcgttagtactgtagaagactcatttttatttctcattagttgctcttgtagatcttcaattttcagttctatgagatccttcatatgaacaaaatttttcatgttgatagtttgtctctcattgtaatcttcatccgcgctggacagccttaaattgaatatcttttctgatagtgatttttcctgtgtcaggggcgactcgaatcctattcttttcattaattgatgcttagattcctctatcttggacaaatgaaaatcaatattacccatttcggaacgtatccgtccagattgcctttttaactcctcttcaatgaatttattgtcctttttgaagtctcttaataaagtttccagccttattatttctgatttagcttgcttatgagataattgtaacagtttgtaattacgtatcatttgatccgcagaagattcagcgttctgtacttcctcgatcattgcatccgaatcatccgtattggatagtattgtattttctgcccccactgactcgatatatttgtttagtgatgtccggtggtgcgatgaaatggtaattatggcgtccttatcgataacatagtccgccggcgcagcatcggtttcttgcttaatatgccacgacttccgctctttccaaagaagctgctctctttcgttcagttctagtagctcttgtttgtctcgaagtaaggacccaatttctcttttcaatagaccatcatgggatactaagagatcattaattctgcatagatcgtttaagcaaatagtgatatccttccggatgcttgtcacctgggaagccgaatttacatcagacaacgctttttcgtgaagcccgaccagagtgcctaagtattgcagaatctgctcctttttttctaaaacctgattcagttccatatttacttcttcactttattttgttaccttatagaacaacgaggttaaaatgtggaacaagaaaacgaaaataatcacttgaactaaaacgtactctatccttcacttttccattccttagccggttctccaatagatatatacagacgttctctgtgttctattatttgtatatgatttacactataaaaagactatctataccttttgttaattgcgcacctaaacgccagagcttacgcccttaaattttttgaacatatgcgctgataccctacaagttgtcctagggctaggatatcgggaaaaaagagacaagggaacttgaaaaaccataattcccaatacataaacctgttacttgatggctaacaagatgtacttttttccagtgacccagtggcttctttaaccactattgtgttcatttctaactctggttaattacataaatattagccttcaaagccgcacacgtttctttttccgaaaaatgaaaaatttttcactagaaaaaaaaaaaaagaagaaatagaaaggtataaatagttgaataatttgcccttccgagatccaacaagatttttgagtgttgggacccttggaggtttactccagtttcgtgggcttgtgcattttcacctagtgtactgggaactttctcttttttactctatttcttttctttcttgcttctatataacttaacttagaaagactttctaaactcgcagaaaagcacgtcatctcatctgtctcacttttattctaaggaaaagaagtcatcgacaggttaacagcagtaaatattatcagtgcaattaataactccgaaagtagtaaaagcaatggccgccgttagagactacaagactgccttggaattcgccaagagcttaccaagactagatggtttgtctgtccaggagttgatggactccaagaccagaggtgggttgacttataacgactttttggttttgccaggtctggttgatttcccatcttctgaagttagcctacaaactaagttgacaaggaatatcactttgaacaccccattcgtttcctctccaatggacaccgtgacagaatcagaaatggccatcttcatggctttgttgggtggtatcggttttattcaccacaactgtaccccagaggaccaagctgacatggtcagaagagtcaagaactatgaaaatgggtttattaacaaccctatagtgatttccccaactactactgtgggtgaagctaagagtatgaaggaaagatttggattttccggtttccccgttacagaagatggtaaaagaaacggaaaattgatgggtatcgtcacttctcgtgatattcagttcgttgaagacaactctttgcttgttcaagatgttatgaccaaaaaccctgtcaccggtgcacaaggtattacattgtctgaaggtaatgaaattttaaagaagattaaaaagggtaagctattgattgttgacgacaatggtaacttagtttctatgctttccagaactgatttaatgaaaaatcagaactatccattggcttctaaatctgccaccaccaagcaactgttatgtggtgctgctatcggtactatcgatgctgataaggaaaggttaagactattagtcgaagcaggtttggatgttgttatcttagattcctctcaaggtaactctattttccaattgaacatgatcaaatggattaaagaaactttcccagatttggaaatcattgctggtaacgttgccaccagagaacaagctgctaacttgattgctgccggtgccgatggtttaagaattggtatgggttcaggctctatttgtatcactcaagaagttatggcctgtggtagaccacaaggtacagccgtctacaacgtgtgtgaatttgctaaccaattcggtattccatgtatggctgatggtggtgttcaaaacattggtcatattaccaaagctttggctcttggttcttctactgttatgatgggtggtatgttagctggtactactgaatctcctggtgaatatttctatcaagatggtaaaagattgaaggcatatcgtggtatgggttccattgacgccatgcaaaagactggtactaaaggtaatgcatctacctcccgttacttttccgaatcagacagtgttttggtcgcacaaggtgtctccggtgctgtcgttgacaaaggttctatcaagaaatttattccatatttgtacaacggtttacaacattcttgtcaagacattggttacaagtccctaactttattaaaggaaaatgtccaaagcggtaaagttagatttgaatttagaaccgcttctgctcaactagaaggtggtgttcataacttacattcttacgaaaagcgtttacataactaattggtaactagggttcattaataataaaataaaactaaaaaatatgtgtttatatttattctgctcgcagttaagtatggaaatcaagaaatagactggaaatgatctatattttcttcgtattttgttagttcatattatctcttgcggatcgtgacagtagcacaagaattcgatgttgcatctcataggaataaaaaagaataaaatgagatttatcacagttgtggctttttctccgctccctttaatattttttcgtagtatttaatcttctcttgttcaacctccgataaagatggtggtaatttttcattaataaggtcttcctttctagccttttcaaaagtgcttagcgtttcattcaaaccttcagtcccacgagctagagcaccacgaggtaagacaccggcattcatagttttcaaatattccactttttcgctctcttctcttagcaccgaaaacattcttgaaactttagcaatagctaatatcttatttctcaaagcctttcttcgggtttcatcttctaatatcgctgatgacgccttttcatcagatggggtgccggtctccttagttgcgtttgctcttgcctttacagtctcctccgcagctttgggttccgattctgggtcaagttcctgctcactacatatgtttaatatagacactaacatgctagtaactttttcgccaacaaaaggtagtgaccaggtgaaaacatccataaaatcaggcaaccagtaagggtgcggagacatgtgaaactgcctgatgttcatgacgttttcttcatattttaacacagcagctttattatgatatgtgtccaggtagtttggcgcactgaacatggttattaagctcgggaagcctgttactttattgtttttatacattctgtacccagcatcctgtgcttcgtgtgctctaataatagataacaaaccatttgccttcaaaaacttgcatgatgctttaaaagtgaaggcgaaagagcaacccctcaaactgttaggtacgaattcatcctcgctctgatcaaattcgctaccatctcttgcatcatcataattttcgacaggatcggcccatagtaggtcacacatgagaccacgagatgggatttctcgaaatctattaattttattaacatcctctactgattttaactctggagagataccaccatgcacacaaaaatattgtccgttcattaaagctgctaatggtaagacattgaatgatctgcagcaagcatcgtaaacttccatatcgtatttgtgcaacatctcattcttaaaagtaaaataagaggtcaagtgcttacactcatggttacctcttagcatccaaaatctccctaaattattcaacttcaaggagtacaaataaatcagacactcaaaagagaatgcacctctatcaacataatcccccaagaataaatagtcgatttcggcggggtcaccgccaacttcaaacagtttcaataaatcataatactgcccgtgaatatcaccacatatagtaattggcgctttgagttttagtagattgggttctttactcaatgctacagttgacatatttaagatttttatggcctgttccttagaaagtcgaccctcatgaaagaaatgctctcttaaaaaggaatgattaggtaatcccgtcttggagtcgaatacttcctcatcacttggtatctttcctgttatggcaggtacagaagcgataggtcggtccttagtagaaattactttaccgttttctaattcgtattttgttaaatcttttttccggtcaacctttatgtaagagtcattaggtttaatgattttgatgcgtgaagaattcaagtctttcgacattggcgttgagagtgttttatggcagctgagctaatacgtcaaaaaaaaaagaatctaaaaaaacttttctttgaataatacctttaataaagcaaatattaaaggctttgcttcgttcttttataataatgcctcttgattcaaaaacattaaaggatttatacatttttcccttttgtttcccagtagtacgttctttttcagaattggaaaattcatgtttcaagaggcgatgacatgaaaaattttgaaatagatatagatgaatatcaaaatgattcaaacagtttgtatttattgcaacaggaagaaaggtggagtccaaagaaatctgcgaaaaatttttatagtgataatccttacggaacaatgagcacacaatatattgatgagacagcatttgttcaggctgagcaaggtaaaaccaatctaatgttctctgacgaaaagcaacaggcacgttttgagctcggtgtttccatggttatttataagtgggatgcgttggatgttgccgtagaaaacagttggggtggtccagactcagctgagaagagagactggattacagggattgtagtagaccttttcaaaaatgaaaaagttgttgacgccgctttaatcgaagaaacgttactttatgcaatgatagatgaatttgaaactaatgttgaagacgactcggctttaccgattgccgtggaggtcatcaacatatataacgactgtttcaatttaaattataataaggtagaaaaattgtatttggaatggcaagaaaagcagagaactaaaaaatcaaaaagagttgtgcatattgagggtgatgatgatgaagacgatgaagatgtagaggactatgatgacgaagatgaagatgaagagatggacgaggttgtacctgacttagtatcgtctaaacctgaaccaattgttgacgaagacggttttgaattggttcaaccaaaaggaagaagaaagcactagtatcttcaaaatctgtatattataattgatagtgcgctgcttttttgcacttccagtaagaaatagcaacaaaattagataaatctcggtggagttatccaaaatatgtaatatatatcaagaaagttacgtattaaacattggacttctagaggagatcttcaatatagatttaaaaggtgggcaatgcatcgctacgtgaagatttttacttttcttcaacatgtgtattttttatgtttcatatttttatattttgtgtttgctaaggtctaatcgttcagctaagttaaagctaagtataagaagcaaaaaatactaaattatactaaattataaattttcgtacataaataatcatgaggtagatgtttaaatatgtaaatagtttcttttttcttctttgtgattgtcaaaatttgtgtctatctatacaaccctctagaggtatatcttaactgtgtattatcatcaaattcgttattattataattgtcattatcgctattaatgaatttaaatttcttgaaaaaagaagatgtcatttccagaaatgaaaaagattcttttctgaagtttgcgatcttaaatagtcggatgtcggttccaacccaaatgttattttcaattatgttgtttacaacgccgggactaatttcttcttcaaacatataactattcaaattatctgtaatgattgacgtgctgacatttggatctctttgactagccttggtgtcatcactgccaccattgctgttatttccaccccatttccatttgaaaaatgaaaatccgccgttactactgttgttgctattaccattagtggaattattgttattagtctcaggagcaacatgatgagaatttggtctagttcttattgaagaactattagaagtagtcttctctaaagtaatggaggacgaagacgaagacgatcttaaatgctgaaagtgattttgcgctgtgttctgaaaaaaataattcatcaagttgccacttccgttactttttgttctatttaatgccattgttggggtacttacacctgagccagcgcttattgttctttctaagcttacagaagattgacctcttgatcttcgtatgtatcccaaacgatctgttgtaggctttgaaatggtattgccttcacattcgtcaatactaatatccaaaagagattcaaattgcctcaattcatgcgaaaaagtttcctcgtatttaaacgacgtctgcgtgaaaatatttgcccatgtggcaatgtggaaccacatcaacagcttatcattagtatgcatagacaaaggctgaaaagttgtcaatcgtcgaacatccagtggtaaccggggatgaattgtggtcaatatatcagatctaagagccgacagtttcgataaagtttcgaaatattgcaccgatttaattctcggaatttcaggaaccttcgacaaaatttgcttaataacccgcaaaagaatttgtaaataaactgtaccggaccaaacttcattaaaattttcatatttgggatttttacatttgtgagtaaacgttagtggtgtaggccattgaggtctatgtggccaatactctaattgatgttgcaaattcagatttgaatctgacttgaaatcaatgaatgcaatgacttggtagttcttatcatgattcgtacttgaaaaatgcttaactgtcccaggtgtttcattttctaatgacgcaggattgaaaagcaaataaggagttggagattcgttttcttgacctgggtcctcattttgattttggcctcgattgtcattttggccttgttgctgattttgatgttgttgatttgctgaagaataaagattgacttgaggcaaatcagttatctcttcaaattgatagaaatccttccattggactttccggttgaatcccatttgcttcaaggtcatgatatgcgaatttaaatttggattcatgtctaaggccttggatatagaatttatagagtcatttatttggtgagtgatggactgatgtctcaccattgcaaatagtagattctccgcatcgtcaaaatataaggtgaaaaatattgtgattgaccttaataataacgccaacaaatccattttgaaacccggtgagatcatatacggtatatcttttgtcttgaagacaggcgtagcgtaagttgtcagataaaccttatttgatgacttagaaagaacgtaaagtagggacattgcagcattgtaggatagtttggacgaggatgtatgactagaggtggctgcacttggtgatgcggacttcttctttgctgataatagaattaaatcgtcatgtgaatcatcatttttgtgagaactggtcaaaatttcgtcattaattggcagcagattgtaaatcaattcataaaaaatcggattcggttgtaaattgaatttaatgttgtctaaaatcaaattcgataattgtatgactgtaaaatctctgaacgtcaaattatttatatcgccgttgatgttggagagtttgtagaaatttggcaaattatttgtataataattaaggttgaaagtctgtagcattttgaagagaacaagtttttttgaagtcaaaatcaggagaagatgattgagtaaaggtaacaagatctgtgaaacgctattttcgttcagttccacaatagaacgctcgttgctcgtatcgttagatgtgccgttgctcgtggtggaagaattcgagcgtgttgttgatgaagacgacgacaacgatgaataatcataatactttaaatagtagatggaaaaaatgatgaatctacttgcaaacttgtctgcaaaataattttggaaacacttattgcaatcaatcaagtttgtcatgagaatagtcataggtatcaacaaaggatgaatctctggtaattgtggctttgtttgcggtttcgtatggtatgccgccgatgatgaactaggcaacgaagcatgcgaagatgaactgttatcgtgagagctcgtcgacacggctctccttctgctggcatcaatatgtttattgtttgtgaagttaaaaatgtttgattcttgttctatggcgagatcgatggggtatttgaaaattttaatgaaactagaaagaattaattttaaatcgtactctcgctgtaattgggtgaggaaaatggtaatgacattgtcttgggccttatatgacatggagagatttaaaacgtgcagacaagactgcacaaattgaaaataaagcgtctgccaattacttgcggtggcgtcggagctgaaaaaattagccttcaagctctggaagtctttattattgttaagtataaaccgcatcgtgcaatttaatagcgaggaagtgaattgaatgcttttgtccttaggcatttgagtacaccagtagacaagaaacatgtttatgtcctgtttaccgccgctcgtgtacaagtccgaagaaaataaagctgccaaaagacgtaaaagaagcagtctattggcaaaaagatgccactgatgatgcatattcagtagtgagcggtacttgttggaattagtcaagatgccgatttcccacaattcgcttgggtgggcggtcacggcagttgtgaaattatcttggaaagccagtttcaagatcgccaacagtagtctttctcccagtgggatgttttgcaagggaagaccctcaatttcatgttgcgtggcccaaaagacatcgtaatggtcctgcgtgctagacttgacccggtcaaaataaataggtatgaggatggaaagggtctttatggcgttgataagccgcgaagaatgaagtcccgtacgggaagcgggcaaggagttcgcggaaagaataatgtagagcgaaaggaagacaatcaagttgttgaagttgggtgggttcaaactagagataatgtgcaggatttttttaaaactagagttaatgctgaagtcctgcacgtccactgatatgaagtccaagtaaaaatcgttgaagacggtatctagcgggacatttggtttgtcgctgaacaacgcttcaacgtcaggcccagaatccagcttaaaaattgacaggtttaaactcaacggatcagcatcaactgaaagggagggcgagggcgacgacgtacgtgaaggggaggacgcatctgcgtcctccggtcgaaccagagcgatgcagtggttcagcaggatcgaactggatttggagtcagtatttcccattatgcatagcctaagggagaatttttatggtttgatttgtgtgtatttctttctctattagctttttctctgatttgtttgcttatctacctgtacgtgtatgttgtgtactcaataaatagaggtctttttttttttctccataggtttacccgaaagaaaaaacaccgaaattaagcacgtaaaccggcggaaaagcaaggaaaaaccccctgaagccaaagcaactgcgatagtttttattatttgttatatcctctataaaaaatgtgcgaacaagagaaaagactatataaagaatctataaaagagaaagtaaagtaggaaaaagagagaaaaaaagagagagataaaaaaaattgtgcaagtctgttaaagtcttctcttggatccattaaccattgtttcgtgctccgcggcaggttccgcgacgtcccatttctcgagcgaggacgcctcggtcgacattgttctctggtttatcagcataggtggtagcgagttagcagtgggcaagggcgaccttgtaaattgcggaacaataacgctcgagtaatctctaatgacacccggctgtagtgaagcgtccgaggtgctcggcgtcctcgatgcataaccctggtcgacccgctgtctgattcgcatacccacagtcatcaactggtccttgtggaaatcctgttgctgctgctgctgctgctcctgttgttgttgttgttgttgaagctgtctctttgggacgaggctgcttgcccattccagttgtgcgtccattaagtcttgtttgttcctgtattagtgtgtgatgtaaagcgtgcgtttcttgatctgggttctcttgctgtttctttttctttgttttcttctccaatccttgcctgttgctactagataaataaataccccactggcgggaaaaagaaaaagcacacacacaaacaaacgagaagaaaaaagcgcgtggtacgagccgcgctaatgaggaatagaacccatgcaccacacgcaaatgtgcgcacggacaaattctgccctctgttaacggcaggacctggcgtcccctgccgttagcggcggctagccgccgacgccgtagtcgcgtgcccttgcccttagcggctgactggctgactcgattgcatatataaattgcggccaccatacgttgagtcttgttgttatatggcggttgttcgtattacagcaaaggatactacaccacaagacaccacagcagcacagaaccacaacaccaatgtccgaagctaccctctcctccaagcaaaccattgaatgggaaaacaaatactccgcccacaactaccaccccttgcccgtcgtttttcacaaggctaagggcgcacatgtgtgggacccggagggtaagctgtacctcgacttcctgagcgcttattctgccgtcaaccagggccattgccatcctcacatcatcaaggctttgacggagcaagcacaaacactaacattgtcctccagagcgttccacaacgatgtttacgcgcaattcgccaagttcgtgaccgaattcttcgggttcgaaaccgttttgcccatgaacaccggtgcagaagccgtggaaactgctttgaagttggccagaagatgggggtacatgaagaagaacatccctcaagataaagccatcattctgggtgccgagggtaacttccacgggagaaccttcggtgctatcagtttgagtaccgactacgaggactccaagttgcatttcgggcctttcgtgcctaacgttgccagtggtcactccgtgcacaagatcagatacggccacgcagaagatttcgtccctatcttggaatctcctgaaggtaagaacgttgccgccatcattctagagccaattcagggtgaagccggtatcgtcgtgccccccgcagactacttcccaaaggtctccgcattatgccgtaagcacaacgtcctattgatcgttgacgaaattcaaaccggtatcggtagaaccggtgagttgctttgctacgaccactacaaggcagaggccaagcctgatattgttttgttaggtaaggctctctcaggtggtgttcttcccgtctcatgtgttctgtcttctcacgacatcatgtcttgctttaccccaggatctcacggttctactttcggcggtaatcctttggcttcccgcgttgccatcgccgccctcgaggtcatccgcgacgagaagctgtgccaaagagccgcccaactgggtagctctttcatcgcccaattgaaagctctccaagccaaatctaacggtataatctctgaggtgcgtggtatgggactgcttaccgccatcgtaatcgacccatccaaggccaatggtaagaccgcttgggacttgtgtctattgatgaaggatcacggcctcttggctaagcccacccacgaccacatcatcagattggctcctcctttggtcatctccgaagaggacttgcaaaccggtgtcgaaaccattgccaagtgtatcgatctgttataatattaatacgcattttttttatgttttctcgtttcttttcttttttttgttttatatcttacacatttttaatatactaaaagtaaaataaaaaaatacgtactgtttccctttgttttctcctcctctttgcttatatctccactgcgccatcgtcatcttcagagggcgtgctgattagagtcactgtgtctcctctgatgaacaccatttcacatcgtctttcggactcactcaactcctcgttgtttaattggtatatggtctctactgcatcactcagcacgatgttgcagtgtgagtcgaacgcttgcagtgtgcccaccagcgtcctggccccgcgcagcttgatgtacaccctctcatcgagattgagtttcaataaatccaaaggtgtctccattttcttgagtgtgcgtgatgttgtgtgtgtgtgtgtatttatctgcgtgtctctcccctgttgtattggttgctagaatggatggaaacatcctgcctcttgtttgttcaaacctcagctttcttgctttttttcttctttcaatatcgcgacctatcacacagcacggatagccaaaagggcgcatcaggaagaagaaaaaatatcatttcagcaaactaaaagaattgccctgaaagctatcgagccctggtaagagagtaccattctatctctgcggctagaaaaaaataccataaaaatataataaaaatgtggaagagatcgttccactcccaaggagggcccctgcgtgccagaacaaagtttaccaaaccaaagccaaaacaaccggtgcttcccaaagacaaaataagaccgcccactcaattgactcatcactccaacaacctgaggattaccgaaccaatcccaccaacaacctcaaacctgcgctgtcccgacgaccacccgctgtggcagttcttctccaacaagaaattcatcaggtccgccgacgacttgccgccttccagccatatcagaccctggagcatcccagagttgaggcacaagtcctttaacgacttgcattccctttggtacaactgcctcagggagcaaaatgtgcttgctcgcgaaaaccatctcttgaaaaacattgttggctccacgcatgacgaattcagtgagctctctaactctatcagaaccaccatgtggcaaataagacatgtacttaacgaaagagagctggcctatagcgcttcacgcgaatttttacaggatgaatcggagaggaaaaagttcttggatactttggccaacgattacttcttgaacaaggatatccctgatgacgaagtcgcctccatgctcacacgattccagttggccattttcggcatatcggaaaccatccaggataatacagtcgacattaacttcatcgacgggatcaagttcttggcaaacttaaaactacagcggttcaaggactccaatgacctcatatccgaaatatcacaagaaccgatcacagacgtgggcgagtcgttcatcttattcacttccgacttcgaacctcatgccgttcaagaggcttgtgtcgccatcaaagacctgagaaagtccccagataataaagtccctaaattagacgaactccccaccgtgagaaaatacttgaaacagctaattcatgcaagctccgtggagcaagcaactgcatgattcccgtgggcttcctaccctctctcctgtaaatatatatatatatatatatccacacacactcgcacatacatacacacatacatacacctttatatagctatacgctgtatgtattcagaaattagtcacgttgtggaaaatctccctagcaatgccgcctaccttactcttattgtcgttctgtccgtccagtgcgtacttgtctttcaccaggtcacgggcgcttagctccaattctagtgtgctccattgcgatgtaacaatttcgacttcctcaagggggcaaacctccagtaagcggcccaagatgctcatctgcagaacaattatctctgtgggaatttcattatccacccaatttggatcgacaaacttccccatttgataaaatgttaaccaatgctcatcgcccaacgccttcatcatatgttggcccgcttcttgacaaatttcaaacacttgcttgcccaattcgtatgctgtgccaaaatctaaattcaccaaggcatagtcaatatgtaataccatcaaatccacttccactttacccgtttggccctctctattaatggataagctgtcgtaaatcccgaataacaagctttttgtagttggcagatccttatacaatcgcgggttcagctctaataagttggatattatatcgagggggcaatctctatattctagaatgttgcttggtttgaaagcggtatctcttgcgccattgtgcgacttatttaggtttatggaataatgcgacaatttgtctgatatctcaagcaatacttccagcttagttagatttgtgcctgcccgttgcgacatatgcttctgaattatttgtaacgtttgcgaagcttttttcatttcaggctctttacgtaatccattagaagcattattgaagaaatgccagaagaacttcaccagaagttcatatatttgggtattgttactgtagtcgaatctttctatgatggcttcaatgtacgcgaactcattcatttgtaagaggatttccaatatactgtatagcttttcatccatactaattcgggtgaaaattttatcatccttgctgatgtccaagaccgtttcatacatggcttgcaaaaaactggagatttcgttggctttgttaaattcttcatggcatagtgaagagaaatgggccaactgagccgattcttcttcctgtgttatggcaaagatttctttaaatgaaaatttcgtggaacatttgatgaagaattccataaattgtttcatctctagagcagtaatagttttctgttcttctattgtaatttcatcagggaatccactcaagatactccataattcatcaagcttatgagttaaactggataaattaaataaattctcactgttgtgaaataatatatcaaccacattactttgcaattttctggacgcttcactgttatcttttactcctttttcgagactgtaatagagctttataaataactggtaattagtatcagattttagtgagaactgctgtttattgaagaattccgtaatgaacgtttcccatttcttcccataagacaaagtgggagctaattcatcttcaataacatctgctataccaatatatccttgcatatcctctacaccgtcaaatattatcttaaataactcgctatcaggcattttttcccattcgttgattttaaatatgagatgaagccgtttatttaggtggtcgaggggttttaatactccttctacccatcctataaattttgtagataacacttttgacttggcagtctcccatagtacagaatataataaaggtgtttcaggtatcatttcattacatattaaaatcctttctctcaaccactcctcaaaattctccaaggtcttgttattgagttttttgcttatgaattcttgcagttcatgatatctgttcgatctcgttgtggtatcactttcaattaatggaatcaaactgctgtcactttctaatagttctactattacatcttcgtcggttgtttcttccccttccggactttgcacctcctcttctaattcacgaagaaacaaaaggttttttgggtcatctaattctggccacaaaacacagagaatctccaagtacttggattgtgagcccagtctagtagacaactttttgatattgcgcgtgtcagccctagatgcaaaaatgcaagctaacaaatatagttgctcttccaacatttttactgcaattttcttggcaacctatcaatactctctgatataaccagttattgtctatttacaattggtttttcttttccctagtttttctttttctctgcaccttgcctcttcctcacaatttcaataaattacagtatatttacgaaagagtaacaaaaatttcaacaggtcacacagagcagaaatacctatttgaaacgaaaggaagatcgttcatgttgctatatatgttcttaaaaatgatttaaaattatacaaatattgtatacagtagtatagttatagaattatctttttgacgaggttaatgacatcatagaatagagagttattaaagagactaaaaaaattaaaatcgaaaaagaaagatttaaaaaataagatatgcatcactcctttttcctgttcctttcctttctattttattattggttcctttacacagtttccaagacttcgtccttgaaaccggtaaccttcttacccttttcttcaccagaaccttcaccgtgcaaagccatcaaagcaccgacatcgaactttggttgtttcaacaacttaacctttctaacatggatgttttgtagtgggaaaatgtccttggtggcgttttcaatttccttgttgataacttctggaatcaacttggaggtcaattgggccaaggtagatccttgaacttccttagtcaagatttcggaaataacctttctgatagctctgatatgggaagattgagcgtaagagtgtctcttaacttggttagcttgctttctggtgaaggcgatagcaaagattctcaaaacgtaatcatcagaagtcttaacagtaacgttagcttcgatcaaagtttgccactttctaaccatggatctcaatttatcagtagtgaagtccataccgtggaagttggtcaataaattcttaccttggacttcgtcaactcttaatttgatttttctgaaagagtggtcttcagaaccctgtaagtcagccaagcaaacttcgacaactctacctttcaaagcatctgaagcactcttcaaaccagtggacttgttaactaaagtcttaccaacatttctgttttcaaaagtggatggagctttaatgtcgaaccattcctttctggtaaatgggtcaacgactctcttcttttgacctttcttacccttggatagtctcttattctttccgacagccatgattaaacgattggttattcgtgtgcttgttttgtttccttaatattaaagttcacaacgtgaacaccttcctttcttaatagaatagttgtgacatctagtcattttgggtatattatcgcgcaggtgagagagtcctggaatttccagcggatggtgacgcgaggcatccgtagtgcacaataaaaagttagtttttcattaaccgaaaaaaaaaaaaaataaaatatattaatgtttgggtttcaacgtttccgtgggtctgggtccacaacagaaaactgtcctgaagtttgattaggttttagtaagtaaacagttatggttacattattaaggaatacagaagagactgcatgtgtacataggcatatctatggcggaagtgaaaatgaatgttggtggtcaaatgcagtccatatttttgaattcttcatccatcgaaaaggcgtaatttatttctaaaggaagttttagttctaccataatgcttgcactgggctcctcgagcaccacaacaactaatttttctcccactaaatcattcactacacttatccaagaaaattgctttagtttctctatagttattgcgggctcccaggcaccgcatatgaccttcttaatttcttttgacgccttgtaccctgggttgtcccgcaacatcttcaccatcttaatcaggacggtctccagagcaagcgtatgacgattcgtgccttcggtttcttgcgccagggtatataaaaatgttctcatcaacagagacattcctataatcttctttgaaatagtttcatccttgaatccgttaatagcttctgagaaatagcgtggtaccatctcctgtgacactaccaatttacccttttgtagaccacctttccgtacgaagtcttttttagaaatttctacggcagcttcacatattttgaatgctttttcagtactaccacttacgttggctacgttctttgcaataagttgagtgattttgttgttgatcttatgattgattactatcacattatctggtattttctggttctgtccttcgcgaatattattgtaaatagtcatttccttcttatcatttactttgacatgaaaaggtttcaataaagatttgagtcgcgtgatgatcatttgttgcaattcattcttgtccaccttattaagtttgatttcggtaaagtgtgctttgagggagggcattatatttatttgctctctaatcgtcacattatgtccgccaacgcaaatgatagacaattttgaatttttcgaagaaatccatttctcgaaatattgtaaaatcttctcactcaatagattttccggattttgtattaatattagtgtctttctcttttttgctttcgggacatttgtaatatagaagtttaaggcctctagtgatatatcaccgcatagattttctttagaaatggcgaaccatattttctcatataatgcatccattcctgccagttccaaggcatcaatatgaatgtaatcgaaaataggtagttcctttcgggccgaagaggtgatcaactcatccattacatcattcacaagctggaatttagtagaatcatctgcattggtaatataaaatagtttattttgggaagacatcaaactgtcgtaaatcggaaggaatattcttgtaaaatcctccacttgtgattttagtagttctctcttttgtaaagattctctaattgattcctctaaatttatatcagcgttaaaatttgacagaatggtttctcttccagatgaagagcatgcttttctaaacttatcctcaaggcctgcaacgtccaagcttgactgttcgtctgttaatttgttcaattgggaggaatctgttacttgattatctggtgcaaaccggtctaaaattatctgatatttttttttcaactttgacaaagtagcgaaatcaatcatctttgcattacctttttctggtgtaggattttcgttcatactatgaattttggtgttgcccctgggaattccaggttttccatttccgttcatttcgttatctgtttctgtagtgtaatttttagaaaattcttgtgtttcttgaatgtggatttttctaattttactgctcaattcgcttccgtgagcgccacgtcttttatttactggtattattgcttcatcagaactttctgaactaacttcatctgtttcctcttcaagcccaccatcatcactcacttctggattatttgcatatacaaaattctctcggccgtcaacgagttctgtagatgtcttctctggctttgacccaggtttacttgaaagcacagatgtttcattgtttggctcataatcggattcctgttctgaagagtttattggtatttcctctgaaacaattagttcctttgatatagatcttttttgtaaaattttcgaagaatctgtaggtgatgtgagcgcagaaggggacgccgatgagatgttaggggaaacagactcttcttggggagaaattgaaccatgagttgttgacgttcctcgctgagacggtatatttccattatttacgtcatcatctgcagagggctcgattttaatttttttcattgaaggtttctttgctagtctttttgaagatctttcaactcccatcttatgcatcacctgtctatttgtcttctgcccactcactggtacagatactcttttcaagtattcatcagattgtttgggttccatttcctttactcttcttatgatttgaaaaatatcaattggtacaaacttttccgcagtaggttcgcatgcataacgtactagaaaatctctatcctctattttatcgatactactatcattccattgtgactctggcagtatctgtccaactgcaatgaaatccttaagccaaatctctgatagctcagcagttaaatataactcgctcttatttacttcgttgaaaaatttatctttgtaaaattctaaaggatgatcttcctttattagatctggcctgaattgttcgtagtacagttttggtttgagttcaaaccatctcaagtaagaaaaaacccaaatctccacaacattattaagtgtattgagtctgatctcatggatcaagtagacagaatatgtttccgtcacattatcattaaatatcacgctctcacccttcccaaaactcaatccatcagaaattcttttcagaaatacgttttctcctcctctttttcttgatcttcttctattgttgtcgtcaataaccctcccctgatcatctgtaatgataacttgccaaccgtccaaatctttcaatgttttagccattttagctaatccaattgttagaacaaaacaactttcttaaacccctgtaaggaaggtgatgaaagggctgcttatgtgtttttctttttcatactatgttcattttaacttttttggaaagaatagcgttttcgcggtcatattactgatgcgatgaaaatttacaattatttctttatttagattgatacataatatggttaactttaaatacatcttttggacgccgcataaacaaacgtcccgaatactttgttcccctggattcgttgtttgcttaacactgtcaactctctacttagtttcatttacaccatttctttgtgtatcagtcattgcgaatacccttgcatatctaatggatcgaaaataaatggtgatgtcaagaatacgagatacaatagccaggccattccagaaccttacagcccttgagaaagtggtacagtggctaagattagggacgacattactcataatctctttcgggttggcgttgactgtcggacccctttcttcgccaagaacattgtacatgtcacgactggatacttactctgctgatattacgacgggtttatttaccgtgttgagagagtctatggagcagtcgacatctacagaagaaaataacggtgtaggcttaacaacatccgaactgtatatattgactgcttacaccgaaagtcagataaagaatgttcctcagtacatcacagtgtcgctttatgggaggtgcgattcaacatataccatggtggaagtattcgactctgaaggaaatatgcatagcgtaaagaattcgactactaagagtacctgcagtagcataggaacggactatctttttgattatcgtgaggttttagaaagcttgggtttagatatcattttagattatgcatacaacaaaatcggttcacaacaggcagaaagttctgcatacacgacctacatgaggagtttaaaacataaaaaggccaacgtgttacatttactctatgcagttattagtttccaggtgtgtatgttatttttcatgatatggtactactacataaagggaaggtttatgaacgccctcaaagaaagggcacttgttcatatcaactctctactatcgctagttgttttcattgggggcctgataagtagcataagccttgcctgggttaactacactattcagtctagaattaatacagaattagaggccttcgggttttcttaccatcttggagttacatggtttgcgcttctgtggtgttttgcaggtttgatttctgtgtcatgcttagcttggtctggcttagaatggtgtatttccgataatggcacgtcctatggaggtggaatcgatgataaattcttaggctaccaagccggtgtatttactgatgcagatctagacgatgaaacttcttacagtcaacgttatccgcaacgacagtctacttcgggcgaggctgaactgatgagaaacagtgatactatggcaacaataagaaaaacatctgatgttgacttaaatagtgaaaatgatgctaacaccagtttagaccatggaaatcccaccgcaaatataagcaatggcggcaaacacgaaccatttgctactagagaggaattcgaattgcaggacataagattccggtcaagcaacgacagtgaagaaagtatgcaaagggttatcaagccttcgtcagcattacagttttgaattctttcacccatcattcaaaatgcatatgcatactatatttgtctagtttttaattatataataataataacagaaacaaaaaatcgcattcatcgtttaatcttatttttcttttttcacctttttcttgtgaaattgccaagcgcttaaaaaatcgttatttcagaactaaacatcattaagcaacgaagaagagaaaagcggaactataaccatgagtgatactacggaagtccctaggcaatcatctgagaacgaccaggataataacttggaaagaaccaactcattaaaaagtccggacgtgaccaacaatataccaagtcttttcaaattagccgccgaatggcaaatcaacaatccacaggaaaccttccaaaaccatatcctggaaaatgatgtactcaagaaaattaatgaaatcactcatttgatccgggaatcgtacaaagacctctccagtcaagatgggatgatgtccaaacaacaacaggaaaagatggattgggatttgttttgtactgttcctgtaaacattattgagcaatatacaaaagacatggacgaaatatatgaaaaaatggaaaggctagcaaaagtaagtataggtcgaaactaggcatcctgtgccatctcaattttactacgttcttttactaataatgcaaatttaataacagcaacaacgtctttggtgtgaatccgcttttcaaatagacgtggaaagatgtggtgactccattctcaatgctgaaacgtggatgaagaagaaagagcgccatttagagtaatattgaaatggaaagatccgcaaatgaaattaaggaaactattcaaagactaacagatgatagatgagccatactcaaatatatctgcgatattgctaatgttagctatttctcacatttgctttttttgattttatttatttacttttacgacaactggccttatcactcggctctctaaaagaagtcatgttcccttcgttgggtttaattttttttttttttttgtttatagtttttttttttttgccaggtattgttagcgccagatagcaaaaaattttattcagggatactgaacaccggggaagttaactgagtatatcggttatcattataaacacaagaatgtaagccagaaagaaaaataaacgtccacccctcgaactttcacatataagcaagtaaagaaaaagttaacaaaaggaggttcagaacatgacaattgaaagcactctagctcgggaattagaaagcttgattttacccgctgattccatagtgaatgtagttgaccaattccaagaggagttgttatcacggcttcagacaaatacgatttctatgctcccgcagtgtttagtcccagataaacgatcgcgatggaaccctgaagacaaaattctgaccattgatttcggcgggacaagactgaaatttgcaattatctctctgccccaaatcgttatcgaatacaatgatgccttcgaacttacctacaacatcgttgattcgaatttctttaatcaaatcatctatacaatatgtaccaggctggctgcaaatggttatataaaaaaaaagaacgagtcatctgaggcgtctaaattttttgtttccgtgacattcagttttcctctaaatccagaaggggaggtagttgcaatgggaaaaggatttgtgatgactgacacccttcaaggatccacggtgaaacagctcatccaatcttcctttcaccggattatatcagaaaatatcgaagaatttttctgtaccatgaacgtgtgtcatgtaataaacgatgcaattgcagtttcactaacaagcaaatttatatgcgaaaacgattccatctcattaataataggaactggtacaaatgcatgttttgaggttccatacggatatttaccacctttcaagagagatgccctgagagaaacattaccgtcaagctataataaggagacattaaatttcaaacatgttctcattaattctgaaattggctttattggtaaaaatgtcattgcattgcaaccgtttgacattcatggagcaatctcatacgaaatgccactagagtgcgttacttctggtaaatggcttcccctatcattaaaaaatattctattgcaatataacataatccccaaaaacttcccagtagagttcaatggggaactggtatgccagctggcagaagactgtactaatgcttggttcgaaaacgaacattatgcactaatttgtcagatcgcacgactattaatcaagagagccgcattttatgttgctgcaattgtacaagctattgatatcatcacaggctgcaaaaactataactttattcatattggctacgttggatcctttctccacaattcaaatttttatcgagagcagataaaatattactccagcatacatattaagttgcaattcttaaatcacagtaatcttctaggcgctgcaatagccacctacttgaacaaatcagacaaccaagttcaataatatatttcatcatttcttaccatcttctcgatctatttttattattcccagaaaactttgtgatgttggtgtagaggaaatgatccggcgcactaacaccacacgcttgtaacaaactaaggatgtcctgaccttttttgattatgttaccaccccatttttgcattctttcttttttttttttttttgggttctgaaaatttttttgcttctacttaattataattttatataatcatatatggatctgattcttaaaaaaaaatgaaaaaaagacaaaacaaaccatataggtaacaatttctcttagtgacataaaagaagaaggaacgataactttttcaataaacggaaatataattgttgattctttctctttggttttgtgcgatacattctgcaatccaggtaatattcctaacttcttgttccttggatttcatccaggcccaaacagtgctgatggcaaattgttgcgtgaaagcatctctacatagttccatttccaattggtaaaagtgatcttctaagttaccagtctccaaaaatcccctatactcatagacgttagctaaagcagctctaactccttcgaaatcttgggcttgcgccaagtgaaacgttgcaagagggtacaacttacctatgttaggtaacaagtcacttttcaaatctgggtcaatatctgaactttgcaaagagttgagtgcaatattgatacttcttctgtcagcttcaaaccctagtaatgtttgcatacattctttagcaggttccggaatttcttcagtgacaaaattgtaaaagtcttctaaataagccttgtacagcttatttctaataatttcaatgttcatatcgtctagctcctctgccgtgtcaaaacagtttttgaagtaaggtgccagtggggtatccaccaatacggtttcgtatagggattcaagatcagtagcaacactcaacgtaggcaaagtatcaaaccaacctagcggatgacaacgttgtaaaatttcacccttatcacgatcatgaatagtacctgtaatcatcaatgctacattgtcgatcatgtaaccataagtgatatagtccatgaactttctcgtggatccactggattggtctcttatgtagttgaattcgtggtacaacttgctagaagcatattcttgaatcaatgacgtggtcaaagactctgaggaaacagaggaaagaaaattaccataatcagttgatgataattgtaattttagatcttccaacgtgtcacattgtgttaagttgatgtattggttattagataacaacccatttctgtagcctctcactacaccttcaataaacccattgtcaatattgaaatacacgccttccatcttcgcaagactttagcaacacgatccgaatggtatactcttttgctagctcttagcgttctttatgccataccttaaagggttaagaggtcaattgttcttttgtttttgcagtatatcgaagatattttaaaaatacgtcactttgtacgcagatatcagcgtaacaataggtgcgcggaaattacttagttccataatacaagaatctgctgactttgcgtctgtaagataagaagggtacggcccagagtatgaatcgttgggggatgaaatcactttttcatcttcctacaattcattttgtccttgaaatacataataacaaaatattaatgaaacttgcatgttaccaaataacttgaacttcagcacttctatttgtataccagtatcacagcattcagcaaatttgattatctctcatgcttcatgtcctaccttttttccttctttcttccttgtcttaatctgaaagttactaataataataaagacaaaatatcacccatgcaccaaaatgtatgggtcataattttttttcttgccttcaaaaatcgttgttagctgcaaaatggcggtgaaacacatagttgtggttatgcgtcccctccgggcggccgcagatggaggatgcccccatgtgctgattctccccgtaggcggcgagtaatatcctcgcctaacctggacttgccgtgctaagtcggccttctaggctgcgcttccgttcagcatcgtttacggtagagggagcacatgggcggaaacaaacctcattctggtcctgtgcttgcccatttgcactgtatagagtgtgtgagtttcaattaatgttgtaggcgcgaggccctgtaatatggcagttgatcaaaagtcaatagataattttcaagcaaaatctcatttaggtttgactactttcttgaacttggaagagaagcaaatatattcaacgaaatgactgcccaacaagtatgtgtaaagatgagtaaattgaaggatgtgatggttatggagatggcacacgtgcctagaggaaaatagttacccaagaacaaaagcaggaagggagctaaccttttaaatatgaactggacaaaactggacaaaatgaaaataacgattttagtaaaaatgaaaatatagcatcaaatgactgagaaacatagtaacaataactcatattatagctaatctgagtaaacttcttcctacgctaagaatttttttgaggatagtaccaaaccttgtgctgaatcagcacacgccatgcccaccatcaattgtgcaagaaaaaagtaaacgagtagtatactaactatatatgtgatttacatcacgatatgtcaattataggccccaaagtggtatccttccgaagacgttgctgccccaaagaaaaccagaaaggctgttcgcccacaaaagttgcgtgcctctctagttccaggcactgttttgatcttgctagctggccgtttcagaggtaagagagttgtctacttgaaacatctagaagacaacactctattggtcactggtccattcaaggtcaatggtgttccattgagaagagtcaacgctcgttatgtcattgctacctctaccaaagtctccgtggaaggtgtcaacgttgaaaaattcaacgttgaatactttgccaaggaaaaattgaccaagaaggaaaagaaggaagctaacttgttcccagaacaacaaactaaggaaatcaagactgaacgtgttgaagatcaaaaggttgttgacaaggctttgttggctgaaatcaagaagaccccattgttgaagcaatatttgtccgcttctttctctttgaagaacggtgacaagccacacctattgaaattctaaattgaactgaaaaaattataaatgatttaaaatagaatttcaaaacaaggagaattgatagagaatgcgttgatctgaaaatactgtttgacaataacggaaaggtaagtggatatgtaatctaagtttaatcctcttctaattcatttttcctatcaacattatctgtgcttttctatatccttctttttgtatctataatttttttttctcttacatagcaaaatacaaaaaatcataaatattaatatctaagggttcaagatcaggtcatcgccgttctgggccactaggctatatctattcatttacattggaagctgcatggtctactccaaccgcactgaggcaaagtctctgtggaggaaatgctgtcctagcgagccattgcaataggtataatcagagtcgtcctcccaatgtgttaacttctctcaaaaccaccatataaattctgtaacctgccagcgataatgttatatatgtaaaaggtaaacatacaacccaatttgtccatactaagtggatgctggggaagcaactacagtgcagatgctaaagtttgctgcggcaaataatctcaacatttttgtgattaaacctgcctcagtggggtgtatgattagtgcgttgatatttaatacacgcgtaaaagttaagtctgttgtacgttttatttcgagtgacgaaagaactacgaataacttcctgcatactgttgcctttttctgtatttacgtatacttttatatcaaatagcttggccaaaagaaagtagcattgtgtatcaagtcataattctaattcttagtttaacttcagcaaaaataatattcttcgtcagacattctcatacaatcattaacccatatgaacgttaaatttctcaatttcttgccttcgatgccctatgtatatttttatctcaaacccgaggcagtgaaaattttagctggtgcatcgaaaagagaagggcattgaaaattttacagtgttaaaagaagtgcttttcatgttagaatgataagaaaaaagaaaaagacaacaaaatatacgtctctaccatgtctgatatgcttccattggctacgtatagcctgaatgttgaaccatactccccaaccccagctctgaacttcaaaattccggttaccattagaatcacaatggcggccatcgaccctgagccctttgacgatgacaaaaagccatctactttaagaataatcaaaaggaatcctgaactcactcgcggtgagtactacaaccaagataacaatgacggcctcgaagaggatgaaagtgaaagtgaacaagaagcagatgtaccaaaaaggagtgtcaaatcaaaaaaaggtaaggcagtcgagcaaagtgaatcagaagactctgaagatgaaaacgaaatcgacgatgaattcgaagaatgcgttcttttaaccttatctccaaaaggccaatatcaacaagctttggatattaccattgcaccagaggaagacgttcaattcgtcgttaccggttcatacactatctctctaaccggtaactacgtcaaacatccattcgacaattcttcagattcagacgaagatgaagaagactattacagtgacgaagaatcttccaatggagaagaagaagaagaagaagaagaagaggacgatgaggaactaagttccggtgatgacgatcttgatgatttagtagatgctagtgacatcgaaagtcgtcttgatgaattagtcaaaaaggacgaaaagaagaaaaacaacaagaaggacagtaaaaggaaacatgaggaagatgaggaagaaagtgctaaacctgccgagaaaaaacaaacgaccaagaaagacaagaaagcagagaaagttaaagactcggaagagagcaaaccaaagccaaagacgaagctactggaaggcggtattatcattgaagaccgcgtcacaggaaaaggcccacatgccaaaaagggtaccagagttggaatgagatatgttggtaagttgaagaacgggaaagtttttgacaagaatacaaagggtaagccttttgtttttaagttgggccaaggcgaagtaattaaaggatgggacatcggtgttgctggtatggcggtcggtggtgagcgtagaattgtcattcctgctccatatgcctacggtaaacaagctttgcccggtattcctgctaactctgaattgacatttgatgttaaattggtctccatgaaatagggtccttaatgcatacgtattgatatatgtatctataatactatatacaattatctatacttccattactaatattatctttcaattttacatgtttttttctgccataaaaaagcaatatttttttgcgagctatttagtgatatagccgcccagctacttgtcgatgcatatattggctgagagtactaatacaattatcggaagacctcaaagtaaaatatagaagctttgagtaaaaggagctcgagttttaaaaatgacttcgtaatatgtaaagtttatgtcatatatacttacacgataaatagaccattgatcgttagagacgagcgcattgttttgttgaatccctttcaacagcgcgacaaaagttaatcgagaacaataagatgttgcattcaagggttagtcaaacatatcagaaggccgttttctaaatcacctcaagaacctaccacacagatacatcttgaagaggtggagtaccaaagggaatattttgtacgagcaagttatagtaagacacttcagtgagaaattaatctgacttacttttacttaattgtgttctttccaaattagttcaacaaggttcccacatacaacctcaaatgtcacttcccttaaaaacgatagtacatttggtaaagccctttgcttgcactgctaggtttagtgcgagatacccaatccacgtcattgttgttgctgttttattgagtgccgctgcttatctatccgtgacacaatcttaccttaacgaatggaagctggactctaatcagtattctacatacttaagcataaagccggatgagttgtttgaaaaatgcacacactactataggtctcctgtgtctgatacatggaagttactcagctctaaagaagccgccgatatttataccccttttcattattatttgtctaccataagttttcaaagtaaggacaattcaacgactttgccttcccttgatgacgttatttacagtgttgaccataccaggtacttattaagtgaagagccaaagataccaactgaactagtgtctgaaaacggaacgaaatggagattgagaaacaacagcaattttattttggacctgcataatatttaccgaaatatggtgaagcaattttctaacaaaacgagcgaatttgatcagttcgatttgtttatcatcctagctgcttaccttactcttttttatactctctgttgcctgtttaatgacatgaggaaaatcggatcaaagttttggttaagcttttctgctctttcaaactctgcatgcgcattatatttatcgctgtacacaactcacagtttattgaagaaaccggcttccttattaagtttggtcattggactaccatttatcgtagtaattattggctttaagcataaagttcgacttgcggcattctcgctacaaaaattccacagaattagtattgacaagaaaataacggtaagcaacattatttatgaggctatgtttcaagaaggtgcctacttaatccgcgactacttattttatattagctccttcattggatgtgctatttatgctagacatcttcccggattggtcaatttctgtattttgtctacatttatgctagttttcgacttgcttttgtctgctactttttattctgccattttatcaatgaagctggaaattaacatcattcacagatcaaccgtcatcagacagactttggaagaggacggagttgtcccaactacagcagatattatatataaggatgaaactgcctcagaaccacattttttgagatctaacgtggctatcattctgggaaaagcatcagttattggtcttttgcttctgatcaacctttatgttttcacagataagttaaatgctacaatactaaacacggtatattttgactctacaatttactcgttaccaaattttatcaattataaagatattggcaatctcagcaatcaagtgatcatttccgtgttgccaaagcaatattatactccgctgaaaaaataccatcagatcgaagattctgttctacttatcattgattccgttagcaatgctattcgggaccaatttatcagcaagttacttttttttgcatttgcagttagtatttccatcaatgtctacttactgaatgctgcaaaaattcacacaggatacatgaacttccaaccacaatcaaataagatcgatgatcttgttgttcagcaaaaatcggcaacgattgagttttcagaaactcgaagtatgcctgcttcttctggcctagaaactccagtgaccgcgaaagatataattatctctgaagaaatccagaataacgaatgcgtctatgctttgagttcccaggacgagcctatccgtcctttatcgaatttagtggaacttatggagaaagaacaattaaagaacatgaataatactgaggtttcgaatcttgtcgtcaacggtaaactgccattatattccttagagaaaaaattagaggacacaactcgtgcggttttagttaggagaaaggcactttcaactttggctgaatcgccaattttagtttccgaaaaattgcccttcagaaattatgattatgatcgcgtttttggagcttgctgtgaaaatgtcatcggctatatgccaataccagttggtgtaattggtccattaattattgatggaacatcttatcacataccaatggcaaccacggaaggttgtttagtggcttcagctatgcgtggttgcaaagccatcaatgctggtggtggtgcaacaactgttttaaccaaagatggtatgactagaggcccagtcgttcgtttccctactttaataagatctggtgcctgcaagatatggttagactcggaagagggacaaaattcaattaaaaaagcttttaattctacatcaaggtttgcacgtttgcaacatattcaaacctgtctagcaggcgatttgctttttatgagatttcggacaactaccggtgacgcaatgggtatgaacatgatatcgaaaggtgtcgaatactctttgaaacaaatggtagaagaatatggttgggaagatatggaagttgtctccgtatctggtaactattgtactgataagaaacctgccgcaatcaattggattgaaggtcgtggtaaaagtgtcgtagctgaagctactattcctggtgatgtcgtaaaaagtgttttaaagagcgatgtttccgctttagttgaattaaatatatccaagaacttggttggatccgcaatggctggatctgttggtggtttcaacgcgcacgcagctaatttggtcactgcacttttcttggcattaggccaagatcctgcgcagaacgtcgaaagttccaactgtataactttgatgaaggaagttgatggtgatttaaggatctctgtttccatgccatctattgaagttggtacgattggcgggggtactgttctggagcctcagggcgccatgcttgatcttctcggcgttcgtggtcctcaccccactgaacctggagcaaatgctaggcaattagctagaataatcgcgtgtgctgtcttggctggtgaactgtctctgtgctccgcacttgctgccggtcacctggtacaaagccatatgactcacaaccgtaaaacaaacaaagccaatgaactgccacaaccaagtaacaaagggcccccctgtaaaacctcagcattattataactcttgtagtttacatggtgatactttatatctttgtattgtctagctattctaaatcatctgcatgtaataagaagttgatcaaaatgactcgctgcgtaaaacctctcttcgatcggaggtgccgcctaatttatcgcctagcactgcgctttttcaaagtttttcagagcaaaaaatgaaaagtaatgagcacaacaatagaagagtatcatgatatataaggtcataaaactaggtttcaggggctatcggcaatttgaggaaccttcaacctgcctcaagtaaaaatcgcttcgtaacattaatacaaattctttttgcaattatggaaggaagatcagattttgtggcgacttcacagtccggaagtgaaatgagccatagtgaaactaggaatagaactgggatgaatgctaggaaaaggaaattcgcctgtgtggaatgtcgtcagcagaagtcgaaatgtgatgctcacgaaagagcaccggagccatgcactaagtgtgctaaaaagaatgtcccatgcattttaaaacgagatttcagaagaacttataaaagagcaaggaacgaagccattgaaaaaagattcaaggaactcaccagaactttgacaaatttaacttcggatgaaattttgaagaaaattgaagaggaacaggaaattgttttggataacagtaatttcacaaaagaaaaagtaaaacaactcaggaagagtgcttttgagacgacagaaatagaaccgagatcatacaaaacacttcgaggagaacctatttcttacagtaccaacagaagacatacggattcttctcctttaacgctcttaagctcgtcgacaaacttcgaccctgttcactcaacaaacgttatgacagatgatcaacttaagtgcttgccaaaaagcctgggcgacgtatatttgtcaagcagcgatattgctgagctgtttcnnnnnnnnnnnnnnnnnnnnnnnnnnnnncgacaaaatatcatcaatttttacccgtcgttgacctttcgaaaggagcagagcgaatttatcacttatctccttgcttattctgggtcatcctgctcattggtttaaggcggaaatttggggctacagacttaatgactcgattatcagtgctagtaaagtcagttttatcagaaatcacaatatctccaataattcgatatactccatcagataaggacgaacccgttctaaatgtagcatctgtatattccgtgcaagcatttcttttatacacgttctggcctcccttaacctcttcattaagcgccgacacttcgtggaataccataggaacagcgatgttccaagcgcttcgggtaggactaaattgtgcaggtttttcaaaagagtatgcttcggcaaattcagaattagttaacgagcaaatacgaacttggatttgctgcaatgttgtatctcaaacagttgcatcatcatttggtttcccagcttatgtttcatttgattatttagtaatcagctctattagagtaccaaattcaaaaagccaagtagatatacccaatgaactaagacaaatggctcaaattgctagatttgagaaccaaatcgtaaacacaatgaactccaccccggcgagtgttactgggatggtaagtcaggaagagaagcagcccttgttacacgttcttaatcaacaactaagtcaattggagattagtcttgaagaaaataacctagatgatatccgaaaatttttattactagtggccaaggttcacttattaacctattacttcactgatgttacctcccaaagtgctggaaaatcaaatggtaatatttatgagggatcatattccattatggaactcgatacaagttttgaaacgaaacgtggattggtgaaagtttataatgccgccgtaaactttcttatacatgccaatagtatgtgggaacatgatcctaccattattaagtactttcctggtttgtttgtcttgaatatatggcaatctgcctgtattattagtaaactcatacattcatcacttcattcaatgctagatgttaactcaggcaaaaaagcttataacaacgcaatttcattgacgtttaatgcctcagttttaaaatatgatatggcgtacagatcatccggaataatgcgaagcatatggagtttatttgctaatatgtatgatgcctggaaaaacgaccaaaaggaaggtggaggtagactaaataatgatttcaatttaggcatcaccataaaatctaggatgtcagtaaacgttttttttgactgcttatatattctaaaagagaaatgtggtatggccaaattggagagagagaccaaggtttctacagcttacaatgttgatgaagaggaagaggaagatgaagatgaggagggagaagaagaagaagaagaagaagaactaagtagtaaagttccagaaaatatggatagccagcaactaaggacaaggaaattcaccaatgtaaggcatccagaaaagaaagcaagaaaaataattgaaacaattccgctagacccaaatccaataaatgcaggctctaccagcagtggaagctcattaacgaccccaaatagtcaagtagcgaacactatatcatatagaggaatcctcaataaaatgtcacctagggaacaactgaatcatgcaaatttagattccagtgtttctacagacatcaaggacactgaagctgtcaatgaacctctgccaatagggaggaatgctgaacatccggcaaatcaaccgcctctttcaataacacaaatgcaagaaaacacactacctgcgacacaagccaactcttctctattagaaacgtatcccattgttcaatcaaaccccgttacaactacaatcaaagaatcacccaattccatcatggcaggttgggataactgggaatctgatatggtttggagggatgttgatattttaatgaatgaatttgcgttcaatcccaaggtttaaagtccttttctttttttgcgtaatgtttacttaccctcgaaaaaatgttatgtaatgactgcggtgctacaggagaggtaaatgattttctatatacgtttatatttcttccatttacgcacactattttttgtccttgaataatttaactcaaaaaaagtgtaaaaaactgtgtcattaggtatatgttcaatacttttgatcttcaaatgacgtaaaaaaaagttttcagacggacttaaaccgccaaccagccttggccacaggtgtatgatgcgaagattcgtaagcgctcacgttagtcacatctcaggattggaaattatactagataataaatggctttatttaatcatattatagttgatataacaaatcacacctccgcttaatttatacgtaatagtatttacagtccttatgggtatcaagacatattaggttaggagaactaaagaaaaaaaaaaggactgtttgtgcaattgtacctgaagatgagtaagactctcaatgaaattagcacttttcttggatttctattaaagcgctagcatctttgtatacgtctgactgggtaaatttttgaaaggaatcgttattcatcagtctatacatttcattgctaacgatctcgaagaggggatataatttcctgaggaccttcaaagttgctggaaatgaatcaaccgatttggtatcattttgggtgttgtccatgccataacgaacaattgtatgtgaattttctactgatgcattaggcgaatgcgtttctgccagagttaacggggcaggtttatattcctttaactgatgtttgaatccttgcttcttaaatgaacagttttcatttgaaagattttttgaaggttttagactcacttcaggtggttcacctaacgtgtcagcctccgttgagctaattgatgaagctgctgattccgcggatgcaggtgatggatcgtatagattagtaggaaagtgttccgataatggagaatgagggtgcaacatgatgtcagaaatattctgacgcaagttatgatggatatttaattgatatggtgatcctatcatgatataggacgaataaatgtgatatgccatttcaaggcactcattggcctgtttcattaaagctgaatcaatcgtttttacgatattgttttttgaagtactggtattagattttttatcacaatgcttagaatctatcaattttttcagaattgtcattttcttcaaaaacctcttaatctcaatgaagacatccaaattttctacacaaagttccttttctaaatggcgcctgaataaatatctcatacctggatcagttagcacatagtccagtttatttaaattactcgaagagataagcatgtcttgagaaaaaccttcactatcatccaatgtctttttttcatcacgaacagtcatatgaccccttaatgtgaaatctaggtctatggtgctaccatttggtgctctaatattattgctcttacaacctgtccaagaaaccaaatcccaaccacgcttggacaaggtaaaaaaagaggacctgctaatttgaaactttttcttgtcagtgcgtgatggttgtaaaagaactggtacaatcaaccccgtttttaaaaataacgctgccaacgagaccgcttctttaacatgcataatatcagtacagtccattatccactgccatatagcctttgttgtaaaggtgtacttaatcacgatttttttggaagtgccaaacgtcttattttcaaacaacctaatacctgcattcgaaacgtagtattgcgtgtgcgactcagaatctggatttgtaaagaatcgatgagctaatggcgataccctttctaagtcatttatatcgatgtttccaatctgagcttgccatccttgttctggcttagatttctcaaaagtaaatgtatcatcattattagtgtattccaacaacgaagataggcaaggtaatgggtcatctgcgtttgttggagaccaaacatttggcttagcgcccatcattttaatgaaaagaatatggatcaaataatcactatggatgattgaatccgtgacagagcttctctcaaaagtgaaaagtttcatggagttaaacgatgacaaaagaatatcaggcattgttttcaacccaatatctctaacatacttttgtaaaacagcaactcccttaggtgttggttggaaaagaactttctcttttggctcgccacgagttctgtcctgcggtgtatgtagtagcttagaagacataaataatgtaagaaggtggcgcgccaaactaggtttaatattatatgaaacgttaatacaagttgtgttcatatccacttttagttccaattgtcccattgctttaatagcttcctgatatgtaaaagtgaagtggaaatgtttagtgaatgcagttaataagaaagacttagtgtcactactatgttttttctctttcaaatccaaacaaattagaaaaatggaatatactgtctttaaatcattggtaaagatcagtccattcggcgttctgctgaaatttttggaagataattcatgcaacgtcctatttttatccaccatcttacaactctatctttaattaccaaattgaacctataacgcctcagatagtgcgtgcaaaacctagaaggaacgtacgacagtaacacctccaaagttaaaggacgatgagaagtaaagacagagctgggattatgatttcattcaccggtataaatataacaggacagacaacaattctaacgcaccagcaaccaaatccaagtcctagtcaaaaaaaaagcagtattgggatcattgtttcaaaattgaatattatgaaacgtttaaaacccagacatcccataattattgaagatgattcagttaaaacttcgcatacttcatggcttcttcattaatagagacaacggaggtggttcaacttgaacttttccaaaggagttgccatctctttgtattgttcgaactctttcaaaagaccttggtaatttatctatcatgtacttttcgagttaacttaagtggaagacgctggtttttcttaaagttataagcactatgtgggtaattttttattgtcagtctgtttctgatcttatccaacaattcatcaaaagttctactctggactataatctcagtgtaagcgttaaacaaataggtaaaagggtgcggaaagaccttcaaaaattcgaaaaagattgctaagttggattctttattattcaactggcatgtgacaagcgagttgtaagactgtaataacttgcttccggaatcaaaggtaaactttatcatttttttcaaatattcttgttcttgagcgcatgttaatatcggcatctcaaacacagtatattttgtgttgagtttctttttgagggatgtcgataggagagacgaaatgctaacgttatttgaataaatgaggaccttaaatgcaatgttattacttttttcaagtaccgataaaacattgataaattcggtaagcttcgaaggttctattatagttgaagtagataatttatctaattgttcgaatttgaagtagacaatatgatcgatactttcgtcattatttattttcctcataaccatcatcattaggtcagacgtgtgatttgaaggtttttcactagcttcgaaatctagttgtccgctatatgaagcctgccccattgactcgatacattcttttgatttgcttgattgaataccctctttcattaagtagtcattcatttctataattacgacatttatatcgactaaagacagtgtttctgaaactgcacggtcgataccagcatattggtgtatatgttcaactttgtcgaagaaaacgatacaatttttcatactcctaagattttttgaaagaaacttacttaagctcggaacgtagcttattgacaaataattggtgcctagctcttgcaaggccattgatttgaacttctggtagaaaacatggtccactcgctccttaactggactcggcttacacacctttgggctgctaacactttttttaattggaacaaggttcaactttctcagtacagtaaaatttttttgctccaaatcatcgcttattgctttcacaatcttgtcactgtcaacaacctttttcgatctccttataggtgcaaaatcggaatctacatgctccattgtctctatatactaaccacgttcgtatttatatctatattcgtacatatattgttctaacttattgaaattgatggttaagaagatcccttctgtacatatctgtaagcgcaatgttttcttcattgaaaacagctgcaaaattagaaaactaaaataataactttcaagataactaagccgggttgccctttgacctagaagcatcccttataataacattatgtgtatgaaaaccatgtcagcaagaacggttacggatatggagtgaagcaaaatctttaaggatttatttacattgaagaggaggaggaaaaaagagccataaggtaaaattcaaatgcataaatgaaactgcccttccttttatacttcctaacctttgcaggagaaaaatatattaaggacaaaagaaaaatagccgctatcatttccaacgctccgggaaaaagagtgtcatagagaccccttatctattttatcatttttaatatgatctattctggcataagtagcttcggatcgattaagcgctattacaattgaaggagtaacaaatttttgggtgaagtttaccaatttattcaattgatcaaatttatggaagatcctcaagaaaaacataaaattaaaacctttatatccagagtttcaaatttgtcaagtttttgttcccgttcactcttgttctgcatatttttcctatttttttggcttgtaactcaaacatgaactacatcacaaatatatcacgttacacgggaaatatacttcccattgcatggaaattaagacggaaataagggagacatgaaaaagggtcttggtggtgttgcagttggacaattaagccattcaatgcgatataaactataaatcccttttaaaagggcctagacatctcagagacaaagaacggtagctattacaaaggacagtaaaagcaaacagctttaaattagatcagaacataagaatccttagaaaagccctttacctcggtatatgtagatgatgtttccgattaatgttctactgtacaagtggcttatatttgcagtgactttcttatggagctgtaaaattttactaaggaagcttttaggaataaatataacatggattaacctgtttaaactagaaatatgcggtttatccttagaagatggtaccgtcaggctaaaatccgttcgttttgctgtatttgaaagaaagcttttcatcaagggtctacgaattgattccaagaaatcatctactaatgatcttcataaagaattaccaagagaggaagaaagaacttttatagagacccccgaagataatggtgggggcttcatttctaagattctttcattatcacaatactggctcaatggggtcacgatcattttggaagatacgcaattagtcaacaacgatatcacgattgaaaaatttggcttttttctttcaattgataactctaaacatatcaagtcactaagatttgattcctttttgagaaaacttctttggaatggccagaccatcattgctgatgccatttttatagtgaatacaaacttactaattggtgaaattatgaatcctctgaaggatggacttcaagtaggattagatttaaaactaggtgatttaaatattcccatgaatttattgaatttatttatcaacaaggagaacgttgatttgatgtccaatgaaaaacttctacaaagattggcagatacaacaaaggcgaatgaagagctaaaggatgaagatatcgctaagatgaaggatgatctcgtgtatgcaatggaaaaatttgtagatcggataaagccattgaaagaaatgaacgtcaccgttgataaacttcaaatcaaagattttccactcaccaatcatccagaactgcttggaatgaacaaatatatcagttataatgttttggtttctaatataaacttcaataccaacaggttcagaaatgagatgccaggttatacgttaatttttgaggagcgtgattctcccttcaagtttagtattataatggcaagatttaatatatatttgaatctaaatcgaaaacatcaaagccacgccaaacagttgaaaattattgaaattccaaatgtttcgatatttggcgaaaccaatttgttctctcaaaaatttcgtctttctaataacctacacgcaaaggaactagagaacgctatttttaacatcaaaggtaatatatcctccttaactattgacatggatccagtaaatatttcctttatcaaatgcttcctatcaaacattaaagtctttacgtcctcttgtccgaaaaacaagattttaaaggagaattctcatgtaaagttcttaacaaggcggagagtcctatttgactattttaagtgttttttgcctctaatcaatatgaaattcaccctggatgatcccaaatttgttatcaatgataaagacgatctgatcataggcaagttttctgtcttcatgataagccatcactctaaaagatatacattgggtaacaatcttatggaagaaaaagaagagacgcaacacattttttatgaaagccattggaatgttgaattactagatatgaaattacagcatattataaaacatcaaaaatacgagcatacaatattaagggtggacagcattgccatagaagaaaaagttcaacttttaccggatatattatgttctgcaaacgctgatatcgacacgctaatgctagatttatctgaacttccaacaatggttatgttgagtgaattagtacacaacttagatagtcagttggcaaatgtcgaagagaattatttcaaagagttctatgaaaagttcgcatctaatttacaaaatatgaaagctgaatgttctaatatggctaaatgtttgagacagaaggaaattttaccaagcgacttcatgttccagcaactacctgattttttcgattatattaaaatcaatattagagacatatcatccaccctaggtgctaggtcggtttttatgccaagagatgttttctcttccgttgactctcaaagttcaaaggacctaattgatggcaaactaagaaaatactgcaatacagtcgaaaaattgcaaattgctttatttggtgacaagacacaatggcataacaaaattggctcaaatcacgctactatggttaggtctggtcagctcacaaattttagtaaagataataaacagaatcctaaccataagtccagtattgccgatttagacgatatatcgactagtgatgcgacagaggtaaatcatctttggaacatcaacttactagtaaatgatataactacgtcaataatcggagagacacccgaagtgagcgaagaattgtccactaaaactgtttccaaagtttctaatttatcaattaagctatttccagacactgagtcatttagtagcaatgaaagcgattcgaagataattttgcaaataaatcactccagaggaacatcggtagtatcactgatgagtatctttttggccgtctcaggaatacacacactgaaccaaatatttggacattgtatacaccaaaagatgcgacagtctaaaactaaacaatactttcttgccctctcagaatccaaaaaaaaatcatgtatcaaaagtataaaatggggccaactaaaggagttactcgaaataaatttctcttctgaatatatcagccaaataatcgcactcccaaatggccttagaacaaaatttgaaccaacttcgacatttatcacagtcaaaaactgtaatacaatttcagtttcaggtcagtacttcagaatgatggtagaatctccaacgcagccaaacttttgggagagaatgatctgtatcaatggatttaaagtaatgatacacattgatttattaaaacagcaaatgaaaaagttaaactctttacagaattgggaaaaattaccatccgccataaccttagaaaatgattcatggcacttttccataccgcatcatttcgagatgtttaaaataatagattctattccaactatatttaagagtattaaacaaatgttatattcgttgaaaacatcaaaagacgatttgataattttcccccacaaaatagagactcctttatcactgccaaagattaaactgaaatctaaaaggtggttatttagcatttctgatgatccactagaggcagaattgaatactatctttcagatcggtttacaagaacaacgggagagacttgcgaaattacaggaattcaataaacgcatctctgaagatttgattaaaagtcaaaagaacgctaaagaaatgaaggacgacttcgaggcaattgataacgcaatactaaagcaccgtacaggattgtgggcaaaggatgggaaaaaaagattgcgtaaatccgcaacagattctgaaatacctcttaccccagcagctttgaacattaatggaaagcgtgatgacaggcctgatagaacgcagtttatttctcccgagattgaaaatgcgtacaatactttattagcgaacttctccgattcatggattaaaagggtgaaagaatataaagttaaagaacgtcgtgagttcgataagaacttttctttcttatggggtttcattgattatactaagctccccaaagatattaacaaaaaagttttacctttctcaacaaatccttttttaatgaatttgataattgagaatatcgatattgatataataaggccttcatgtggcattgaaaatattccaaacttcattcacgatgttggaaaaggcgttccgaagaatacagaatattcgattatgattccgatgcatttagatgcgaaatttagtgaagtaagatggcatttgagagattatcccctgccttttgttagtatacctcactaagctctacaacaaagtaaagaaacaannnnnnnnnnctatgagaatttatggggattttatgataacagaggatatgcttcaatccgacagagagcttagaactttatttgttcctttaataccatcggtaactgttgaaaatacagatagatattactcgttgttcgtgcccagaacaatgactagcgctaagatattcaccgatctaaattttgaaataaactctaaccatacaacacgagtaacttggggtggttcttatcaaccagccattcaacaaacaatgcaatgtttggataacttttcaaagcctccattagatccttctgttaaactagggttttgggataaaacaagatatcttttccatggaaagatcaatatagtttggaaaaagaggggaaaattcgaaatttcccttaaaggcgcaaaaagtccctatatgcttggcggcgaatcagctggtttcatagttggttttgatggtaatgttaacttaaaatgtaacgaagataatgatcccaaaaaatttttatcctgcagcgcagacaaggtccatttcagcattcccaattattttgcaaagccgttactggtatggtctagacctagtaccaatacaatgttcattccaaaccaggacgatacgaacatgcagagatatgcttcattttactatttattgaacactacatcaagtaaaaacgaaaaagcagacaaggaaattatgggaaaatcgttcattgaaaagacaggaattaaactatctgggggtatgacactggatatgggtattctcttcgaaaggttggggcctagtttgaatgagagaacttttgagtccaaaaagcattatttgactcgtctatgtaacccaatttacgttcaagatctctcaaaacatgattcatatgctggctttagaagtgactttatacatatgtctttcgggctatcatctaactcaaactccgcatataacgctatgcaactaagtcccaacgggttcaaggcattctttgtttggtggaaatcattttcaggaaactttcccgtaaggagagggccattatttggtctccaaagtatcagtcctaaatttggtgaacatttatataccatttcttaccacgcagatgtctcaccattattcattaattacatgtaccacaacgctgatgccgatcaaattttgcgtaaaaactacttagaagttgccgaatttgctggtttaaaggctaaatcttctcattttattatggatcttcatcaaaggaaggaagtattgactgaatatcaagccggcttgaacgtcagaaggagagttatgaaattaaaatttctggctggtgatgttgtatgccaggacgtggacatccggactgtaagtggtgagttcagtaaattaaactacattgaagagaaagaggatgctgaatatgatatttttgataatgatatgtcgtggcttgatataacagattttcaagatgcatttttcattaaccctgataattatcttccaaaaattaagattatgccatttgccttttctcctcagttcgcttatcaaaaaagagctagttatggtgacaaataccaagttgatccgaaaacatgcaagccaataacgccgtttgataatcgtgtctcccatggctgtacactagggcacaatgtttctttacgtactgacctagttgagaaacgtgttacagttttgaagaagtttcgagagaaattgcaggagggtattagaaaaaacaaatcagccggtgtatcagaggagaatttgaatgatttactctcaaaagcaaattctagtgtggaaaatgcagaattactactgaaagacttccagaagatatttaaacaacatgaagccggacaaacagaacagcctttccatttcgactctttaaatctattgaaaaacaccaaaaagaccctgaaacaatttgaacatagattttttatttttaacgtactgttgaaatggaacgaggacgcaagaagtgctattttcaaatttttttactatgctaacctatccaatgaatttgcttctttagcaagtggcaagggcctaagggaatttgaagatgtaataaagcaaagagaaatgactgatgatacaacgagtatggaagcgataccagaaggaacagacaaagcaaacaccactaaacaatgtcatagctgcgatgatacagagttcaccactgagaaccttttgaatatatttgaaaaaaatattacacaactgtcttgtgacatcaaaaataagatacaccataagttttttgtccaatttataactccacaaattcagttgacatccctggaaaatccagaagcttgtgttttggtttcttcacccttttttatgctaaagacattggaatttgatgcaaacactaccagtaacacgtatatgcaagatatttttttgaaaagacatggcattctattcggaaacgccaatgcctttttatttaataaaaaggattaccaagagttttttgaactatacttcggctccagctcatatggccaagataaaaaagaacagtggccaccatggctaggcttggagttaggattcgaaccttctgcattaaaaaagaaagcagtggttaggaatatttctgctctgcttcatcatcagaaattagcaccgttttctgctaaatatgactccttaaaagataaaatagaagataatatttgcggatacgttcctcaagttaacgtacaagtgaattctgacgagtacctaatgctgacgaagatggccttgaaattattcctttatgtagaacccgaagatgaagaattgaagaaatatattgaaaaactaattattggttacgatatctatgatacagcccaaactagaaaattcgtaaatgatttacacgatagtgaacaaattctagctgttgttgaaaaggagcttttattcaaaagaagcctattggacgacattggaaaactcgatctatccaatattcacaacgaacgcatgcatcagttgttgaggttgtatatcttaaggaaggttttcacttcaaatggaaacaattacattaataggactttagtatggaatatcaaggttaatgaaactatcttgcatttattagacaaaattgacaaaccatttttagatattgccgttgcaaagctaaactttcaaagaatccaacacacgatgggattaaggaagaacactgtaaccgtaaaaatgatgcaaatatttgacttaggcgaaaatgttaattatcattgtattttagggcctttgataacatcaagtggtaatgacacagtcggtttggcgagtgatgttccgttagttcaaataacttgggatgttgataagcctgtaggtggtattaaggttgttaaaaacgttgagaccactttgtcgagtttgacgataaaattagaagaggacagactaaataaactttttgagtggttatcgttaaaggagttaatttacgatggaaacggagatgacgatgatggagcttccagtatttttgatatggtgtcatcagaatcagaggaaggaaaaattgagttttcagaagatattagttctgatttcaatgaaatgttaaagagatcaagtgattatatgatcgttgaagatcttaaattgaacagcttcaaactttgtatcagttataagggcaaaggaaagatgagattggctaacgttactaactttgttttcaatttcccgactttaagattgtccaaccaaactttgagggtcacagatctattacttgcccttaaaaaagtgttaatcaaggttttaataaaacatactgggagatttattggtaataaattgaaaagaaattctaaggagaataaaattgctgacgacacttcaccactgaagcaactcacaacttataattcctacacggagcctgaagaacttcgttaaaaacattcaaaaaaaatttatagtttttcatatctcttaatgtagcatcatacatatcaatatgttaccatgtttcagacctttattgctgtactacattgaaatacctaggattcgaagaacaaaaaacatcatataggtcttccattagtaatgcccattatttacttaaagtaaaaaaaataatggtctctagcgggatcgaaccgctgatccccgcgttattagcacggtgccttaaccaactgggccaagagaccatgaaaaggacgtcaaaacaaggtcacacgaaaaccataacctgtagtataaatataagacatctcaagcacttgttattaattagggaaatagctaacagcatttgaacgataactaaggcaaacaatcctcagtagtaatcgttggaaaaaagatctgagaactaggtgaattttgtgataattgttaaaattccatagttgataaaggcaataacattatgtatgcaggatatgctgaagttcttctcgaggacatatgaatcctcaaagtggaatcggtagtcctgcactataatattacaattatttttcctttcgttttatatgcttacttatcctattacattatcaatctttgcatttcagcttccattaagtcagatgactgtttctcaatctttatgtcgtctttttataccgcatatgataatacacttgtaacatgaacactggtcaatagatgatgatagggtttcgttccaacaccatcacgttatcaattctttcgtgtcaactcctcatttacgttatactctttacattgtgtatggcagtatactagtagtgagaatactagtcaataggttataattgatttttattttaacaagtaacatcttcggaaaagcgactactattcaactaataatcatcaatttttacttcaagaaagcataataacgtctgcatttatgtgtgagcaggactgagcgattctgagggcacttgtattcaccaatttgcaatagctgatctttacaatctgcatgttccgataacaaaaataacttgtaggataaatcctcagagttacatcggtgtgtcagggaatgaacagataaaagaaataacgtcgcactgtaaagtgagtagcagcaaaattaaactattcggacattttaaaaccctatcagtcgccttggatgataaccttatttcaaccacctatcaatgaaaatggcttaaacttccccaattaaaaaactctgcaatagcgtgttgatttcttccagattgatagtttggtacaatacggaagaaacaaggtctctctccatttacattacggtaagctgttcttaattgaactttgaaacatccaatggcgggtaataattatagtatttttcttttctattttatttatttttttttttttgtattttctagaataatcaatcaatggtaaataaacaaaagttgcttctgttgtaaaaaatacatcaaaggggctaaaatatcaatatacgtttcgttaagttctgcagagagatttggacatatctatttttctctcagatatttgttattgcatattgtgagttgactactggtaagcttatattggaagtttcacaagcattcttttaggacctacagtcgttgctcctcctggctttttttcccttttatttttttctgtttttacttccatttcttttgtgatattagctatccctggtttggtccgcaagtttatgacaaaagatattagaacaggcgatttagtgttatgcaaagttggctcgtttccaccttggccagctgtagtatttccacagcgtttgctgcgaaacgatgtatatagaaagagaaaatccaattgtgttgctgtttgttttttcaacgatccaacttattattgggaacaacccagtagattaaaggagctagatcaagacagcattcacaatttcatattagaacatagtaaaaatgcaaaccaaagggaattggtcaatgcttataaggaagcaaaaaattttgatgatttcaacgtatttttacaagaaaagtttgaagaagaaaacaggttaagtgatctaaaagcgtttgagaaaagtgaaggttctaaaatcgttgccggagaagatccctttgtaggtcgaacaaaagtagtgaataaaagaaaaaaaaattcaatatccatcaaagaagatccggaagataaccagaaatcaaatgaagaagaaagcaaaccgaacatcaaaccgtccaaaaaaaagagacccacagctaattcgggaggaaaatcaaacagtggcaataaaaagaaagttaaattagactattccagaagagtagaaatttcacagttatttcgccgcaggattcaaagaaatctaatccagagagaaacacctcctactgagcatgagatcaaggaaactcatgaactattaaatagaatatatgagaattctgacaccaaacggcccttttttgatttgaaggccctacgcgaaagcaaattacacaagctactgaaagcaattgttaatgatcctgacttaggcgaatttcacccactttgtaaagaaattttactgtcctgggcagacctaatcacagaactgaagaaagaaaagttgcaagcgctacctacgccttgataataatacttattgaatcaattcaatatatcaacgtttcaatatccaatattgtttcatttcatttcatttcaaataaacagtgttttaccgtttgttttgtttcccttctttttttcatcaaatggtaatattaaattgatttaattatccatccataaaaattgtattaataagtcatacacgtaatgtcacaacaaaatatcaggcgtactcttgtgacgtaccaaagcgcttagaaacgataaaggcccgggacagaaatttaaacgtcacaagtgggtgcagcccagttaacactaatgttaacgcacttctagatacctcatatatataaatattatctagaatttcaaatttgatattccttttctatactgaataaacgataaatacgaagttcagagtgcgaaaattagggttgcaggcgtctgatctgaaaaacgtataattgatagtgaaaattatgcaacattctgcaaaggaaagtaaaccttaaaaaaacaaatctctcaagcctttaaagatgaaactcaatgaacaaataccaaaagacctgttacgcctgattaaaagttccaagtatgttcatgtggcgacatgctcgtcaaattgtataccatctgtttcgttgatgcattacatatttgtttcatccgcggaaactttccataaacatgagtatagtatagaaatagattgtaatgactatattatattcacagtgttcgagaaatcagtaacctttcgtaatgtcatgagcaacccaaacgttgcattgctatttcacgattggatcacagctaaaaatttaactcttcgaaaaaaaagcgtccatagtaaagatgatttttcatttgttgagtcagagtctacaaaatttaacaactttttacgagatttgaaccaaagtgaattgaatcaagtgagcgctactatcaatggtattgctgatattgtgaaccctaatagtgaagaatctacttattataggcggttgttattaacagtcaatccagacgcagatatttttatactaggagaagatacagccataataaaggtaaatatacaaaaaataaaagtctctgacatggaaaataatacttctacatacggccaaacagtacaaccagtttaacggaaatatgatgaaaactatgtgtactctaattattatataaagcatctataaaatgaatcatgaggattaggccgtgatcttcgcgctccatatatggagaatacttttaatttcacaggagaaattaagataaataacttgaaaagtccactgagattggtgaaagtgtttcatcctctttttcagtttcccttgaacgatagggtggagtgggacaggcgggagatatgttttcctgtaacggctgcatctctggtatatttccatcccgattatatgttttcatggggctggaagtgaataatgaattcgttcttcttattggagacggggaaagatcaattttcaagggcttaatctcatcgttttctctagctagattagacatggttctcctagatttggtgtatgatggatgaatgtttgaagaatctagtaaatcctccaaaatcctgtacttctcatttgagtaattcaatgcttcttgtaatgattgtagcttgctttccaaggcttttattttctcatctcttttcttaatttgccgctgtagaagaatttctctatctaagtataatgattgatttctatcttttccactcgacccgtcagaactaccacttcttagttcactgatccgttgcttattgtatttcaactccgatatctttctcttaaaggcatcactccttaggatcctagatttggctgtatctgtgtccatataagaaggtcttccctgggatctcttcttcaaaattctagtcatgtcgccacaaacattttgcatcttgctcatattttcattatcattggaaaaaacatctctgattgtctggaatatctttgttaaccttcgtttgggtgttttcctcctgttagtacgaattttttcttcagttttcctatctgtcacctttctaggtctttttagaacgcttttacccgtaggacgcatctgctttcttctgctccttaaggcagatcgttttctcacttcatcaagggacccgtattctcgtttcctgccatcatctcgtattccaaaaaaatctttccacagtccctgtacggattttagcatattaccaatgtctattattgtacctttctcttcagagtatctacttgttcatgttcagcaataatttcataattgttgatgcgcgcatcgtttctatactatgacgcgtcacgaattgtgctagagtggcctctaatgaaagtataagaggcgttggcgaaggtcaaggatagaccattggctgtttcggatgagttatttttaaagtgtaaaggtataacatcaaatgaatgaaaattaacattgatctcagctctcaatttctttcctcatttgttttcgatgtttctatatgagtatacattaaacaagtaaatctcaagctcttgtcaaaacagttatttccaacatatctatctgcattattggtagcataattctcaaaggaagctaaaacatccttcttaaagacgtctattggcaaacgatatgttacgtattccgggtaaaacaaatattccattaagtgaaatgacctttgttttcaaaactaaccagttttagaacagtaattcatataaacaacgtgatcttatatgaaaaactcaccaaaaggagaccaatggattccacagcacttaaggtagctctaggctgtattgcaattcgtttggctgtgaacagcctttttccctctctacaacaacaactggaccagtctgtagaattctcaactcccgtaacttcatttaggtcactacaggaaggtatatacctactgcggaacaacatccaagtatataatcatggggttgttcaccatcctccaattttgattttttttctttccctctttaattccgacaggttaatttccctcatatacgctttaattgatggattaattgcgtatcagctgacagaggtaacaaaggctttcaaaaacttgaaactgaaagtttggctacctggacttctttatgccgtgaatcctttgacccttttatcgtgcattagtcggtcatcaatcatattcacaaattttgctatttcatcgtcattgtattgcatattagctgaaggaaacgttcttttgtcctctgttatgatttctatatctggatatttgtcagtataccctattctcctcttaattccgctattaggtatgctgaaaagttggaggcaaagaatattatctgccattgtttccatactatctttattaattctgctattattcagctacagtatattaggcagccaaagttggtcatttttgacacaggtttatggatctattataacctttgagaaggtttttccaaatctgggtttgtggtggtacttcttcattgaaatgtttgacaccttcataccgttcttcaaggctgtattcaacatttttattgcagtattcattacaccatttactttgcgctatcataagcagccattctacgcattcattttatgcattgggtggattgtccttacaaagccatatccctcactaggtgacgctggttttttcttcagcttcctacctttcttcacgccactatttggatatttaagataccccatcatatcagcattactgtttttacacgcaattgttttggcgccaattttctatcatctttgggttgttttaggttcagggaatagtaattttttctatgctatttccctagtttatgctctggctatagcatctatattagttgacttgaactgggcgatgctgagaattgaatacgataacggtatcccaaatttcaaattgaaggtaacacaaatttaactacttcccgtctataaacgtacataaactagaataaaaagaaccatacagatgttcatcgtaagagtggataaagcgaatatgagagccatattggttattccagaggctatctattttttaagagaaactgcttggttaaaatttgcataatattgtctcggagagaaaagatagaactcagaaggacctaattaatcatgagcgttataatacgaagaattgagatagagtgtatgatctgcggattaagctcctacataataacaacattgtacttgggactatgccaatttctttcccaccaaaagtcgtatgaaaaaggttatcttcgctagggcttccattaggtgaaagccaatatattatcatagaatagcacggcataaatatatattttgtgctgtctttttgggaagggtagtttgacaacccatgtacattaacataaaaagagctttatcattaacggacgaagaaagaatgtgtatcgcgtatttttagactatcgataatcttttttaaagttatggtagatagaagatggaatcagttacgaagtgatgagttcccatacattccagcctgtttacattagctaatttaaaaaaaaaaaacataattagaatattacgtgatgactcagtttaaacggtactctgtaacacatcatttctatttgttgttctaaaacaggttctacatatttggatctgctgtgagaatgacctaaaaggtaaaactctctttgtaataatccaaggaaagtgggagttccttggggaagctctattgcaatatattgtagtttccattcagcctgcttatcgccttaggaaaaaggaatgtaagaggcagaaaagtgcggcgcaatcgttcggacagcgagccgccattataggtaagaatacttaaagagcttcgccggatattattacagtgtattaaatttcgccaagtctttgccaatggaaatgggtgcataaatttatgtgcttggtacatatgagttcaatagatatgtagtagttggatagtagatagttaggatatataatcatggaagggttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtttttcaccagagttcttaccatatttgatgtcttttaggatatgaggaacatcacaaagcccgttcttatagacccttactggaatatggcgaatttgtccatcattaatctttggattgatgaatttgataaattttattgcagctttcctagcttctgagtcggctggtaaagtaatgtttccaaatggtacttcatggccacctattgaatatagccttattatgtcaatagtaacgttttgtctcctgttctcttttttgacgttttcttctgtcaaattttttaattcaacaattgtagcatcctgtttatcggccgcacatttgtacacttgttgaagcgtatcttnnnnnnnnnngattcgcgacacagtcgactaaatacgagatattgttgtacttgtgtttaatttgttctaccacgtcaatatcatgataatcaaataattcatcagcaccatattctttcaaaagtttttcgtgcttccgagaagccacaacaatgatcttggtgaagccattcaatttattggctaattggatgagcgactgacctactgcagttgcaccgccccataataagatggggccttttctttgtggggttgatggctcccacttcaggtccaagcccaagttataggtcaacaccaagccagctgtggtcagtgacactgggatagtggctgccccttccaaagacctgacagggccggcaggtagaacatcttcacccaaaaatttgagttcattgggtgatttgtaggcaaccacagttgaaatagcagaatattcagcaaaagcaccattggaaggaaaccttacggaagatccgtgaatgaacccataaatataatcaccnnnnnnnnnngatagaaaagtctttaggattgacagctgggcccaatttgacaatttggccagcagcatcacatcccagaatagatccttgaggcccgatcttgtagtcaatgtgtgcccaatcagtggggttaccagcaacagcgagtgtcttaatcaatacgaatccttcttccaattcaggaatgggaatgccctctttaacaaccgctttaccgtcttcaatgacgacagccttcatggtttctggaattgcaacttgcatgtttgtaggttatctgtaattgtcgttgataatctgtattcagcttgccattttatagaatatggttagaaagatcttaagctagataaagaaaaagaaaaaaatagaaaaaagcctgcccgctttataagaacttttctcaatatctgttgaggaacacttagtaatatcgtctatcatggttgctttattcttagtgatattactctctgggattcgatgtgttctcatcatctgaagggttttctatgtgttgaaagcctatcccactagacggagccgcgcgtcagccgggcggatccgagacatcttagtcagctgagacaagaaaggcacagctctcggacaggaactgctgtcatatgaaaacctaaaaatgtttcctggaaattccatgactgcgcaaagtttgatacgtttattgttcttctccactaccgcactttctatctcggaaacctttcaactaaatgaactattgttaattgtatggcgtgtggcctttctatttcagaaaatttagagtaaagtaaactccgtcggactagtatagtaatgaaacaagccattgactctgcagcatattgcgaccaaaacctggaaattggtggctatgagttttaatttataattatatgaaaacaaagcttggaatgctgagtactttttcttcaatgctgctcactgcccagaagcgttcagaacaactctactggagccattctgcttgaaggaggataaaaatgccaagatcaagtcttttaaagattctatcccttttcatcgaagaagcactacaagtttattttacagaagttgacaaactgtggaacttgatccatactgaataagtatggaaaactgttaacttagaggatgctctgctttctaaagaagtttcacagctttagactcacatgggttctcatgagtattgctagctagtgcgagtttgatctatacttcacagacttttaacaccccgttccttaagttttccctgattatcaagggtatttccaattcttactccccactatcgctcctttcttatctgaattgtatttttgagtggcctaattgtaatcttttattttgttttctaattattgaaggcggtttctcgaagcatttcacgatttccaaaattcaagaattgaaattatgaacatagaagacaaaatactttttttatcaactattaatacacctttcctagagaacatttttaaaataaaataaaataaagtagcgctctctactacccttacacttttctccttcatatctggctagaaaagagggattacatctcggaatcaaatatttccctctgtgcaaagttttaatactgctactacgaactggttacaattttatttttatcatacacgatactttgaacatcaacttctctcaataccatccgccttcagcggctacaattacgtaattgcaccaaggcattcgccgagagttcacaaattgcagaccctaacagtatacgactcccaacacacgtttaatgttgtacgaattcaagagatagaaatgcttcttccgcggaagccgtttaaagcactgaaattaggcttagacaatagacttctgtacgagggtccaaatctaaaattcagatattctttttgaccgaaaacggaaatcacaggcgcgcaaaagggtttttcaaggtaccccggcatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaagttgctgaagccgttttcaactacggtgacttcaccaccatgttgactggtattgccccagaccaagtgaccagaatgatcaccggtgttccatggtactccagcagattaaagccagctatctccaaggctctatccaaagatggtatctacactatcgcaaactagggacgagtgcctctacgaatgaaaattcatagacagtaaaaagtaatgaaaaataaaataaaaactacttttttttgatgatataaataccgtagattatataaatgtatattaatattataaacctatttgatcaatgacagtgttcgtgaagcattttatgaatacgataaacataaaaagaaacttttacactattctagaaaaagggtggatggtaataaagctaatagagtatgtccaataaacaataatgaaattggaagcgcatgacttctcagcactttgtctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcggatagcatatgggaatggaaataggatacaattttatcatagcacccgcatgagtgtcaacacagtaccatattatagcacagtgaatggagagtgttacgacagtgaggtagcatattattctaatgtatggtctgcataagtacgaaatattctgaaatggcatccgttcaagcaaactgcaatattaaggaacttttacgttaatgacgtcatggtagtgttcatactccaagtcaatatgtttttgtattattgttgaagaatagaatatttttatgtttaggtgattttagtggtgatttttctgtaatattggcataagtgtatttaaattgagtggttagtatatggtgcaaaagtaatataacgtatgtattaagagcatttttacaatattcgaggccactgaatgagatatagatattaaaatgtggataatcatgggatttatgggtaaatggcacagagtatagaccgctgaggcaagtgccgtgcataatgatgtgagtgcatttggcactgatttagtgagagatgggccatggagtggagtggaatatgagagtagggtaagttgagatggtatatactgtagtatccgtgtgcgtatgacatatcagtatacaagtgaaggtgagtgtggcaagtggtggtgatggtatagagtgatagggtaagtatatgtgtattgtttacgatcatttgttaacgtttcaatatggtgggtagaacaacagtatggtgagtagtagatgggagatggtagaggaatggcagggtaagtggtggcggagttggatatgggtaattggagggtaacggttatggtggacggtgggttggtggtaggaagtagagaggtggatggtagttgggagtggtatagttgaatgagacagggtaacgagtggggagtagggtaatggagggtaagttgagagacaggttgatcagggttagagtagggtagtgttagggttaggtgtgtgtgtgtgtgtgggtgtggtgtgtgggtgtgtgggtgtggtgtggtgtgtgtgtgtgtggtgtgtgggtgtggtgggtgtggtgtgggtgtgggtgtgggtgtggggtgtgggtgtggtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatttgaatcgatccccacggaagtgcggtcattctacgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttgcgtgtcctggaacgttgtcacgaaatagcgagtgccaggccgaacgacagctctacgatgcgtactttcactgactttgtttccggcgcacctattgtaaggagtcttcagaaaagcaccataaggaaatatgggtacaatttgggaccctacacgtagatgagctatcgattttttctgcataccaagcaagcttacctggcgaaaagaaagtcgacacagagcggctgaagcgtgatctatgcccacgtaaacccactgagataaagtacttttcacagatatgtaacgatatgatgaacaaaaaggaccgattgggtgatattttgcatattatcttgcgagcatgtgcgctcaatttcggggcgggtccccgtggtggcgctggtgacgaagaggatcgatttattacgaatgaagaccccattattccctctgtggacgagcatgtaagttgcgcagtcctaacactgcacgatgccgtgaaagctttattggtgtcgtcttgtgcttgtaccgcaagggatttagatatatttgatgacaacaacggcgttgcaatgtggaaatggatcaaaattctgtaccacgaagtagcgcgggaaaccacgctgaaggactcttatagaataactttggtatcttcttctgatggtatatcagtatgtggaaaactttttaatcgcgagtatgtccgcggcttttactttgcatgcagggctcagttcgatgacctttggggagagttgaacaactgcttcaccacacacaccacacaccacacccacacacacaccacacccacacaccacacccacacccacacaccacaccacacccactactctaaccctattctaatccaaccctgatcaacctgtctccaaacctaccctcacattaccctacctctccactcgttaccctgtctcattcaaccataccactcccaaccaccatccatctctctacttnnnnnnnnnnnnnnnnnnnnnnnnnnnnnnnnnngtcaccagcccaccgtccaccataaccgttaccctcccattactcatatttaaccccactaccacttaccctgccattaccctaccatccaccatgtcctactcactgtactgttgttctaccctccatattgaaacgttaacaaataatcgtaaataatacacatatacttaccctaccactctaatcccaccacacatcacatgccatactcaccttcacttgtatactgatatggtatacgcacacggatgctacagtatataccactctcaacttaccctactctcacattccactccatggcccagtctcactaaatcagtacgatgcactcacatcattattcacggcacttgcctcagcggtttataccctgtgcaatttacccataaaacccacgattatccacattttaatatctatatctcattcagcggctccaaatattgtataactgctcttaatgcatacattataccacttttactccatatactaaccattcaatttatacacacttatttcaatatacccacaaaatcaccactaaaattacctaaacataaaaatattctactcttcaacaataatacataaacacactcaattgcgtatctataccaccatgacgtcattaacgtaaaagttccttaatattaccattgcttgaacggatgccatttcaaaatatttcgtacttacacagaccatacattagaataatatgcacctcactattgtaacactctttattcactaagttataatatagtagtggctcacactcatgcgggtgctatgatacaatggcatcctatttccattcccatatgctaaccgcaatatcctaaaaggataactgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccagtgataactctggtgacttgttcagctggaataccagtcaacatggtggtgaagtcaccatagttgaaaacagcttcagcaatttcaactgggtaggtctcacttggatgagctgcttgaaacaagtagtattgggccaaatgagctctgatatcggagacgtaaacacccaattcgaccaagttaactctttcgtcagatggagatagagtggtagtggctggggcagcggcaacaccagcagcgatggcggcgacaccagcagcgattgaagttaatttgaccattatatttgttttgtttcttagtgctgatataagcttaacaggaaagaaaggaataaaaacatattctcaaagacatacagttgaagcagctctatttatacccatgccttcatcagtcatcactacttaaacgattcgttaacaagtgctcatttagcacctcacatatcctnnnnnnnnnnctatatctcatctttcacacaatctcattatcactatggagatgctcttgtttctgaacgaatcatacatctttcatagacttcgtatgtggagtactgttttatggcactcatgtgtattcgtatgcgtagaatgtgagaatgccaattatagggtgccgaggtgccttataaaacccttttctgtgcctgtgacatttcctttttcggtcaaaaagaatatccgaattttagatttggaccctcgtacagaagcttattgtctaagcccatattcagtctgctctaaacggcttccatgcaagaaatatttctatctcttgaattcgtacaacattaaacgtgtgttgggagtcgtatactgttagcgtctgcaaattcgtgaattctccgcgaatgccttggtgcaattacgtaattgtagccgctgaaggcggatggtattgagagaagttgatgttcaaagaatcgtgtatgataaaaataaaattgtaacagtttataaatactaaactttacttgaaaagtcttttagtccgaaaatgaatgtgggaatactaattacaagcctcccatggcacttcttcatttctttttgactacgaacatggcactttttcaattaattatatttaataaatatttctttttacttaaattttacaaaacccaaggtcattatggtgattaaaccacagtatatatatgtatatgttgaagaggtttcaattcggccaaaacgacagtactatatctgagtctgcactagacaatattgaatttacttaccaattagcattaatataccagaaaaatatcgaatttctttttccggaataaaatacttctctttcaaaatattcatttgcaaattagaatacataggatattatgatgtgcacctaaaatatagagaaacatacttagaacttacatatcaaacgttatcttagttattaaaaatgaaaaatagctgggcagtgacacctgaaataccccaaaaaaaagagcaactatctagaaaagtatgtagaagtccgaaaggaacagagggtgccaccaatagctttcacaaagagttcctttcgtgttggcaaaaaaaatgagtcacttactacaggttcaatttttataattcaattgttgtacctatctggaaaagaagtcctcaaaattactccacccggaaatagctgtatcaaagaaggcacttggagaacctaatatatcatcgatgaaattttccgagaaatcttctaaaggtccctctaaatcatttagtatagttgttaaactgttttcagttgcatcattttcggtttcaggcccttcatcgatatttttcattcctttgttaaaagctcttcttcctattttttccattgatataataatagaaaagtaataggagttttgccaaatttgagtaagaggtttcaacttttcttggtgaatatgatcaaatatgttttccatttctttaaatgcaattttcagtgaaatacacttattgtgtggaccctcaaagtctccaggacatatagaataagttagtgcggacgaatttctctgaatgaataattggatatctttattttccatatactgtagaaaaatggtataaatttgaattaatgctctgaaagcgttcacataaataagaaacaacgcattgtttaaatggggccattttttggagaggcataatgacttagaagataatttgctgttgtctaattcaaaataggtctcaaggacattaaagcacaaatgtaatgaatttagtggagccaggacgctaaaattgaatattctcgcatcaaaatcttgatgtgttaaggtataaagattggataaacttcctatcatatggagagttgcatgccataattgaagttcggtgaactcattaccatttaaattagatgcatttaagtaaaaatccaacggcttaaacattttaatggtgaacttttttaagtcctcgatgatgagtggaatgtcaggcggtttctcacgagcatgaatttgtttcataatatttctcagtcttaatgttgttttatacagaaggatgtcccctgatgaagaatagttttctagacgtaccttgtttacaaaatcgtcgttgattcggaccggaattcctgtagagagtgaaattttaacgtccgtgaataggatccataaccacaatctctccaagtaaggtatttcctctattggatgatttttactcagatataaacgacgaagatcttcattaaggcccatatggatagctgtgtcaattgtcagaccatgaataaatatgcaatgtgactgatcgcccccgtcaagacccgccacatttatgtacaggtaacgtaaaaataaaaattgcacacgctcagtataaaaaactttagccgaaacaaaagacgttaaaactttatggaagacttcaatagcctctggcacttcttttggatgggatgctaagcacataatggctgtcataacacccactttataataattttttttactgtccagattaagggaaattattgtgtgctgaccagttttatgacttcttgggcctttaacaaaacaatcttgcagatcccttaatactttttctttatgaacaatttggtaactatcgtaaaaatcgctagcaaaaaaatcagttaaatactcacacaaaacttcataatttggaagcgattcacataagtattcaataacacttggtgagcctgagtgcggtggggcagtctcaatggaactaatctccgagagtgttgagtaatgatgctctcttttccagttgttacggctgagttttaggacttgccatatctcctctctgtatttggcaaaagtatctgtttgagttgctaatattgctcgatacgacgttggtccataaagaatgtgcctattgtgctttgaagataaatatctcatgttggaaagagggttttgtccttcgtgaatgttaggctgggattgttttgttagctgagattcaagctcttcaatacgacgagccatctctaattttgaacatctcctgtattttttcctgagttggtcctccatggcggaagtgttttctttatattcacattgctttcgatttcgagaagagcaacttccacagaacggtcttactcgatcgcacttgagctttcttactctacaaaagtggcacgactttgcaggctttcttctactctgcctatctaattttttttttgactaagttccgtattcttcattttctattgattatggaaagtatattgctacagattcattatttccaaagcaaccgttattggttactagtgctggacaattgatatgtaatcagttgctatacatctagatcaagttgctctcttcttttgacgtttcgaatattttttgacttcaaacttgaagtgcacactcatcttttcaaggttttttatgattctccgttttatggctattcccgcttttaacatagaggcgatgcatggaagacaataattattttaaggtgcttttgagatcaagatatttttaagagtactcactatgggtatgagataataaaatatattccgttttcttattatttccattcttcagatttttacaggctaaacacacatatataaaaatgccatcggatattcaattcagtatcctgctattgatatagaactatataactgatactagaatatactaattcgtgcactattaaccgtttggcgatgtccgaagaacggcatgaagatcatcatagggatgttgaaaataaattgaatttaaatggtaaagacgatattaacgggaatacctcaatctcgatcgaggtgcctgatggaggatatgggtggtttattcttcttgcttttattctgtacaacttttctacttggggggcaaattctggttatgctatttatttagcgcattatttagagaataatacttttgctggtgggagtaaattagactatgcttctataggtgggttagcattcagttgtggacttttttttgccccagttataacatggctttatcatatattttcaattcaattcattataggcttagggatactgtttcaaggggcagcgctactgcttgcagctttttctgtcacactctgggaaatttatctcacgcaaggcgttttaattggattcggtttagcatttattttcatacccagtgtcacactcatcccactatggttcagaaataaaagatctttagcctctggtataggaactgctggaagcgggttaggtggtattgtctttaacttgggaatgcaaagtattctacaaaagaggggcgttaaatgggcgctcattgctcagtgcataatatgcacatcacttagcaccattgcgcttatgttgaccagaacaacacatcaaggcctacgtcaacataagagatcttacaaatttgaattgctagattatgatgtgctttcaaatttcgcggtctggttactttttggatttgtatcatttgctatgttaggatatgttgtccttttgtattccttgtctgattttaccgttagtttaggttatactagtaagcaaggctcatacgtatcgtgcatggtgagtgtcggctctctgctgggacgaccaattgtgggtcacattgctgataaatatggatcactaacagttggcatgatattgcaccttgtcatggccatcctttgttgggccatgtggataccttgtaaaaatttggccactgcgatagcttttggattattggttggttctattatgggaacaatttggccaacaattgcttcaattgttacacgcattgttggtcttcaaaagcttcctggtacctttggtagtacctggatttttatggcggcttttgccttagttgcccccataatcggtctggaacttcgttcaactgatacgaatggaaacgattattatcgtacagcaatattcgtgggttttgcgtactttggtgttagtttatgccaatggctattgagagggtttataatagctcgagatgagattgctgtgcgtgaagcctattcagctgaccaaaatgaattgcatttaaacgttaagttatcacatatgagtaaatgtctttttcgttataaacaattacctaggagagtctaaaggtcacttttatttcacactgtagataagaaggggatagagttgccagaaaattttttgctttatcagctttttagatttgtcttctcgttttataaataatgataatttagtacaataatagataataaaaacatttttttttgcaaattgaaagcttaactggttttttaaaagaaaatattagtgaccttctaccgactaaaatcttccactaaatccccagtagaaacataagataaggttgaaacttttttagggcgattatatttttagtcctatacatgtttgatggcatactttttaaggaagatttatgaagctatgttccacataggtttatgtgctattgatatatactataaataaaacgctctacccaagaaatgaaacattttttaaacttttgtcatcagcacaaaaatatgcggatttacgcgtttgtcattcctataaaccttaaccttaacgcgaaaccatatttcgctacctaatgttggttcggtgcattttgagaaaaggaactaggttcagatatcatgcatcgaatctattatcttccaaccgaacttttacaaacgtttagaccgagcgttattgactgaattaagagcaagtttttacacgtgtgactctggcacattagagctgtttgagaatctaaagtcttgctgtctaaggaccaaaaataatgtatttcgaggtcatagctaagaatctcattgttcttcagcacttgctaatcacatatctatttctaagtacaagatgatagttaacaactaataatgaataaaccaggtaaaaaaaaaaaagaaaaagctgtaaaagacgacaacgttggcgtcgcgaaaatattaatagaaccatatgttggataatgtagcctctattatacacttatcccgattacattgttttagcgacggtaatcatctttttatccggcactctgaatcaaactctatctttaagtatcctatatgcatgagttatgtcgattatatcgaagactcggtgtgtgatattactccacagtacaaaaacaggaatacagagaaaattgaaaagatatatgaacggatggtatggtaaataaaataacagccattataaagcttgtggtaaattttccaggacggaagttagcttatgcagttttgtttatcttccttgcatctgtgtataatactgaaacacgcaattaacgtttcataaaatttgcctgagggccgtataaaaattcagtgaccattgttcacactttaaatatagccaaattgccaagaaagggtttcattgcaggtttatcgaaatattaactctttaaatacagggactatacagagctaacttcttaagaaaaaaaaccatgcgacacactacgactttcacaaattccataaaagagatatttaagatttagataaaatatcaaaggactgctgtactctgcttcaattacctccttaccataaagttataggcagctttctccatcgacatactaaaatttggataggtattattaatgaaatgactagttttaagtaaaaaatgatcaccagcattgatactcttcaaagtactcaatggcttttgcagacttatctaaaactatttttgcggtttcattcctcactttgtcaacaaaaataggaggtccacagcaaaccacagataatgagccactcaattcagccgcttcatgtagaagttccttaacatttggtcgcccgcaatggaaaacaacaccatcaaaaccaagtggattggcagacttttctaaagtagttgccacaacagtgcctttttcatcagccttctcatcctgttgagaaatatctaaactatcactaggggttaatgatgggacttccattgtgttgtagatgtgaagctgtacattcagattttctaaacacatcaactccggcttataagcctcgagtacgtcgaatcctctaactgcaatcactaattttacagattgttttccagcagccgctgacgtctttccaagtttaattgcatgtgcaataggtccaggcaaaccggtacctccagtgagtaacaatacattattgtaattattgaccggagatgaagaaccatatggaccttctatagctagtctcatagatgtcttacctccattgcgacacacatactttttgacaagtcttgttactccctttttttctttcaggataataaccagttcaccattcttgcttactgaatccaaaacagtaaatggatgtgactgccagaagtacagtggatgtaaaaacgaaacgaaaacatattgcccaggtttggccctccatggccttgccggttttttaactgttaaacgaatgagatcatccccgattagttgtagggaagctttggggaaaccaaaataagaagctttgataattctaataatccggtcaacgatccaaatcgcaatagcagtgtatatccactcaatgccacttaaactaacaacatgctcccaacatgcataaaagaacattgcaccaaggacgatatgaagaaaaagaaaggcttcataaaaatacttcctgaatactgcaaaggaaaagaaaaccattgtgccagctaaacaaagtgctgccaccccgaattgccaatataatcggtttttacttgttgcccaagttttattcgctaccgtataactagtatatgcagagccatgaatcatagcatccaaaaacatcattcttcccaaccatttgtgaaacataatgaaggaagtatatttaaccccagaaatatactcgagaaagttgtttcttcccgcgaaaagaactattaatggaaagtgtgcgaatgcgagtacaccacttctgtctgccacatatcgagcaacttgaactctacgagacttgaatattatattttcaggatcgtattcataaccgtatgccaaaaaaacggtatgaagcacgagatatccaagaataatgataccctctaatcttgtaggtaaatatcctgtgaatattctaaaataagagaaatctgacgcatgtttgcttccaatggtaggtagagtgaggtatccccttacatatcccacaagcttttgcttcaatagaacagttttaaagggagtgtaattcatgcaatgaagaacgcctgcaaaagccatgatagcgacaaaataagcacatataatgccaccatatatgtttccgacatctaagttagcatagaaaccatgcaatgcatgatagtaggcttttcttaactgtgtatccatttcaactggatatgttaggtttgcactgcctttgacatagggcgtcatatgcctcgttccgttgtttagaacgtcataaaactcagaattagtcatgttctgaagagcatcactataacttgcacagttttttttgatggtactaaatgttttttctaaggttttattcgaataacctttttcatccaacgtttcatagatacaatacagcattgattgaaacgctggttcgtaagaacatactggtgatgaacgcttagacttgctggtatactcccaagtaactttttgaaaaatcctcgtgcaggcattagtgacaagcaagggcaccttgttacgaataactgtctttgcaggtgatgctcttgctcctgacaggcagaaaagcaaaatagcgctcaagatggacgtccaatgcattatattcgttgggtttcataagctttggataaaaaagactttattacaactgtagcaaaaaatcatgttcattttttgcgacttatatatttagtggcaaattaatgataccttgcaataaccgaatttagagtatgttgtccaagaaaggagggattttgttcatcagaaaagaattcagaaaagcaaggaaacagtactatcgtttagaatgtagaatgataggttgcttgctaattctattatggcacgaatgatacacccatattttcaacaaaatcaatacccactagcatcattgagccaactatttgtcaatgcaaccattaccggtacttcatcctgatttaacgagtctacttttttatcacgtcaaaatttacttgttttcctgtaaacccgaaataaaggcaaaaaagacctgggtgcaattacgaataaatgtacaataatcatcctgtttgcatagtaaacttccagttagagtcacacaacgcaatgaattttgacagttttctgtgcgatattctttggtaaacgtaaagaacaggcaacttttggtacaatggattctagcccatatggttcatttctggtgcattcgcaaagtcagtatttgtctagctgtgttttctggctgagagacattatgatgttattcattgttatggatatctctgtagctcatgctgcttatttctccctaaaaaagttttttctctcgaatacattcttgaccatttcatagtgaaattcttgtacttatttaaaaccaaaaatggaagtattcatacatccccctatcaaaaacactcaataagtttcgaattattcgttcgtctaaacagtgtccaatactcaaaggggtattcaagacggcacaaaatcagcatcttcccttatccgtgttccagaaataccacgctaaggtttttcctcctacaatccataaaatcattaaggaggcagcttgaaaaatcttgaaattcaaaagagttatcttgggctaatcgaaattaacgataaccagagtagaatattcaagatcacagctccaccttagtttcgaggttgctctcaatggtctagcttagtcatgctttttgttaaacaaatcttgccttttctgatattctatagtgtggtccaatccagatattggcgcatcctaaaccaattatagttcacttatgaagggcaaatgaacactcttaccagtttcacaaataattagtactagctaggcggtcaaactgactagcttattataatattatcgatgtaacatttttccatagtgagggaggaaaataaaccttaaaaaaatatgcaaggattctagatttcaggctagtcttcaaccactttgcacttccggattaaaggcttttatagaaaacatcttggtttgggactatattgctaggtgaaaatttcaaaattgtacaaaagatcattcttgtttttttgcctcattagctgatacaatgcggaactacatggcgctcttttataagcatctactatggtacattctaagtatgtggatcttggttaacacatagacattttttaacttcttgatatcggttccgctaaatttgctgattatatttgttcactaggccagatcataatgcctgtaatattgagtacttaatatcgatacttgatatccgaacagtaaacgtttgtccgtagtcatcgtgactgttgacgtattaactgcaagaaatgatggaaaaaatttaggtatatttgcagatgaaaactctagaacactgccgttgaagaaagaatggcttcagccgtcatgctgtctatctgtttgtaaacttttggaagttttacatattttgcactattttctttagcacgaggtatatgtttctttttcaataaaaatcgtccttttgaagagccaagaacacttttgatttgagtgtataggataataatattgcttctagcgcttaatgaccatgtttgtacttacctctctcccaccttgtataggcggattggctataataacgcgttatatgcatcaaaatatgtagttctctttcattttagcaaattcgtaatacgactccagataataataccaagtcatttttgggtaccagtgagaattgggtctcataactgattgtgaatctcaatattacagtgatgtgagggaaaatacttaattaaaaaggaaaaaagaaatgttacttttctattttaaatgaagattcagtttgttaaacatggattttccatagcattaggtttttatatttccaaatccattttatttaaacttttgaatcatgggatataaagttacatgcaataggaaaagttgtcatgaactccatttgaaactaaggaagaacagtaacagaagttttttgttatgaattattcatgaacttagagctgctaatttggagtgggtccaagtcatcatttttttgcggggctatgattacacaatctgcgcacataatataatcggctttgtatctttaacatcaagtaagaccttgaaaatttattctatctttagacaatgaacggagttacagaacgattttcgtcttccccatttgatcaaaaactaactgaaaattgcagtgttgtaatttttgaaacgccgaacgaagttttcaccaacttaacagaagcagaagaccgttcttgaactaggctgcactgtagaacgctgagcactttaccattcaccacgctattttcaacggaaaaatcaataaatccttgaattgccttcatttaaatgccaattacacctcgtatatctaaaattgctgacatatattatttctttttgatacttcgctgggaatctcacagaaaggtggctctagaatacagaagaacaaagtacatagtccgtaattgatgtatgaagttaatgggaaagtacgaatggtactgtccactcaagtaatactttgagattgaaatttgaagctttttcaagtaaataccataatgataccaacaatgatacctacaattttaaatatcgtaattgttaacttgatttttcataatctcatttaccgacttgcaatactaaacgggtaccagcagacaatagaaaaccttctcatttgaaatgaattctaattgtgaaggcggaaatgcgtactttgaggaacgtctattgtcgtataaaagttttacaattaactaagccaatgtatgatacgcccgcttggcggctttttctttccgactatataaatgcaaatagtcagaagttgtaactccaataacaaacccctcataccgtcctcaaattggcatatcgctatcagaatgagaggcgatggggttaaagataggagtatagatgtgttatccctcaaacatttcgaatcccagaaagttgttctgcctcaagaccttttcatggataacttcacctggatgttttatgagttcttcaagtgcttcacgtttcgtacctggttgctattattactgctaatgtggttgccaggttttctttcgcagataaagtccatcaatcggatttttccgtttaaactttgtattttagtctcatgcctagtggggatatttttacccaatatttattcattctctcataaaagtgtgttaacgaatcaacttactcagttctccaaagaaattgttgaacatgcaccaggtactgatactcatgattgggaaacagttgcggcaaatctaaattcttacttctatgaaaataaagcttggaatactgagtacttctttttcaatgctgcagagtgtcaaaaagcattcagaaaagttcttctcgaaccattctctgtgaagaaagatgaatcttcgaaaataaaatcatttggggattctgtcccctacatcgaagaggccttgcaagtctattccacagaatttgacaaaaagtggaagttgttcaatactgagaaagtgtggagccctgataacttggaacatgttcagctccccaagaaaacttatcgttataagtttacctgggttctcaagaggattttcaatctctggctttttccagcatttattctgtttctggcttgtatctatgtgtcatgggataagggccatctatttcgtatcttgtgttgtgggggaggttttctccttatggtaagagtttttcaaaatatgaggcccttttccatgcacatggaagacaaaatgcagttcttgtcaacgattataaatgagcaagaaagtggtgcgaatggatgggacgaaattgcaaagaaaatgaacaggtacttgtttgagaaaaaagtctggactagtgaagagtttttctttgatgggattgactgtgaatggttttttaaccacttcttttaccgccttctatctacaaagaaacctatgtttgatagacctctaaacgtggaactatggccatacattaaagaagcgcaattgacccgcaaacaggcgcctcccgtgtaggaacaagcatgccttttcaatttatagatcgtgtagtttattagatgcgaatagcctaaacaaggtcgcttattattattattacaactattctttttcctattcccctctggttaacaaaaaccagtatattaacagaaataaataataataacaaaaaaatatgaatataagaataaattgcaataaatagtaatatttataaaatataaaaagaagaaatttttattctttttatattttattataaaatagttcaattatttatattatttaaatgttgtaatttattattaataattatattttatcaatatttatacgatataaaaatttaaaaaaattataatatagaaataataaataataataatatgataataaaataatatataaataaaaatgataagattatattaatttatttaattttcaaattattaaataaataataacctaatacttacttttcctaatattattaaaaatggttattgtcaaacccattaactgattatattataatatttcaatatttaattcacttaatttgttgttataataattaatgaaatagagaaactataatccaattgattgtgcaacagtttgatcttccaaatcataaaagaatattgagtgttagttggtactggtcataactatccattttgaacataaccatgtaactcttttcccgtctactgttaatcaagggaacatgttgaaagttatatcaatacatgtgttgagtatttcacgcgaatttattgctacaaaagagcactaagtaatacatcgttaatttctgcggtagaactgacctggtgaccttgcttgatgctttattgtttgtgggatctgtcacgtatatcgccatatttttttcctacggatataatgtaaaacactaatttatccttcagggttgctctttaaaactcaattgttgaataacttggtattcatatatgtggctgctgcgaatatcttgacacatattatgattatcaaaaaaaagtgaagaactaaatttaggaggatttctacagttttggtcttggttaggtaataattccttaaaatagaggcttatcctttcctgtggaccataaatatcttcatgcaagatctcgattgattagtaataagagcagacgatattgtgtgtggaaaagagaattttttctgcgtataaaataggacattatgacagttacctttaattgaagtagagatatgttttttcaacttagaagctatgtctttactgggtgtaagcctaggaacgctcttctgttttagttcaaaatatgcaaaagaaactaatataccagtaatgctcatagtcacagtcagaagttatattattagtttgacataagcagtattcttccctctcacacactatcattctgccaaaaaattttcccacataagggtgtcagttcagtgaaatataatactagtagaaaaatatgtagagttatcagagtataaatcagctagaggctttttttgctgaactcacttcaaaatctcaaccatgttattaatgttaagtcaaatgatatatgccgtgtgaaagtagacaactaaagctttccaattcttcactataaaactgaactcaaaattcaaaagtatacactaaatcgttgggccatcttccttcccagagattaaagtagcatatctcttcatgtctacattacctccacttagtattatgcctactttcttcccaactagctcttccttttttagaagtgcacctgcaaatcccaaacaagctgtgggctcaacaaccaccttcatgcgttccgcaagaaagtgcatgcattttactagctcttggtcgctaaccgttaaaatatcatcgacattttcgcgaataatggcaaatgtgtactcaccgaggtgttgtgtttgagcgccatctgcgatagtttttggcgtattgatatgaacaatggaacccgatctgaaggattgttgtccatcgttaccagcttcaggttcaaccccaaaaattttgcagcctggagaaaggcttctagcggcaagtgcagatcctgaaaggagcccaccaccgcccaaaggaacaaataatgcatcaagttgtccaacctcttctaatagctcttttgccgacgtaccttgccctgcaataacatcaggatgatcgtagggcggaatcaatgcaaaaccatgttcggctgctagttgacgcccaatctgctcgcgatcttcagtatacctgttataccttatgatatgtgctccgtaaccggctgtagcagcaactttaagggcgggcgcatcctcgggcataacaattgttgcaggtacatttaatagttttgcactaagagcaatagcctgtgcatggtttcctgatgagaaggcaattactcccttacttcttttttcatcacttaattttgaaacagcattcattgctccacgaaacttgaacgctcccactcgttggaaattctcacctttaaagtatatttgtgctccaagtcgatcattaagcattcgtgaagtgagaaccggtgttttatttacatattctttaattctgttgctggcatccaaaacgtctccataagtgggaacaatcatttttccaactcaatgaaaactaaatatctcgaactatattaattatttgtactttttaagttttttttcaatactcctttatttgaatttttgcagaatgaaaatgtaactctttatattccaaagcttatctttttctcacgtaccgtcctatagaccctgattttatgataagaggctgaatttactaattagtcatttttttcagtttttttgtcatagaagccacatttaaaagaagtcagccaagttacctgtaaatattaaaacaacctgcttagaatgactgttaatttacagaatttacgataaaaatataacttggctctagggcgtgatgatagtgacaaaaaactcgtcaagtaaatgttgggagcttacttgccgtcgttttctaacgccaaaatacacgaatcatgtttgggaaatataagtgattagaacttgtccaaggatattgtcaaacaataacatactacaataatcctagatcgtgtattatttgcgtatggataaatatacctcaagctttatgaggcatagaaaattcattagagtcactacttacgtcgcactctcgaggattggaatgacgaaatcttcttcagcatttcaccattcaccttttgaagcttcctatctcgttgcttaagtagaatgaaagcatagcagcccaaaagaaaagcctccctcagcaagaatattaacaaagaacaattcatggaccgtttctactacttaatatctctatcacaactgtcagtctcaatcagtacttaaatgacgctgcagaaaaagatatcattatttttatcatccccctaataaaataagtaatgaatcaatgccattaattcgggaactagtcatatacctaaggaatcaggctttgatagctctttaataataatattagggcatttttgatatggtaaaagattagattaggaaaccccttttgtagagcatctcactacaatatctgcaaaaacggtcaccttgcataggcagaacacgctacctttgagttaattcacaggggagagccctttttttttcttagcaaaagtgcttaacaatcttaatttctggaatgttttcggcggattgttgtatattgtttgaatttgttcgttctaaaaagtgagacacctgcactttccacgccaagaacactaatacctttaaacatgccagcgtactttaaaatgccacgagtcgccccgtaccaaacatgctggcgattgtaatttttcgccttttattggaatcgagaattcgggcactgtccttttcttcgtcatttcaatgttataatcatttttatcgccaaattttcttcaataaaaggtctcttttaaaatatgttactatgttttttatttttctattatttttctatgtgatttttcagacgatttattctttgttcgaaggagaacagatgcaacggtcaagtttttactatccacatgaggagccgtaatattctaaaggcaaaagcatgtgtgcttgtaaaaaaaaatcaaaaaaagttactgctccaagccagcaagctttctcttttgcgaaatctttaacacggttaaaatcaaagacaattacttcattgacaaggtcaatgctaatatttacggtctccgcacgaaagactctgaaaaatgttaaaatttatagtggctaatgctaattcaagaatagtctcgggttgtttgatcacattattttaatttttattgagcactgaataggacccgtatgttccaatcagtctatttcttgcaacttaatctggtttgtttttaggggagtggcattttttttagggttattcaaatattcaattctgtaatttgcttacgacaaaaagaaaaggagagatgaaaaaagggcgacgggtataatctattcagccgccaatgtcccgacgtatgccaaaatgtggtgccgcggtaacagtagcatcacacagagcatgagaaaagcaagaaaagtggaagtctgtatgtcacatttttattgaaaatgctatttgctataaggttcgctattcaactgattgaaccgagatagacaaaatgttaaacttttcatagagacgttattgtgatagggtttacgctgagaatggttgaaacatacttgctaataaaccacgtcacgtcaaaatatcagtttttcttttttagttattcccttctcacttttgacttgagatgagatcgttacacttttattgaatacgaacggatcacgatacatccacatatacgaatgttcggccagacagggcatcagagtatataccctttttcctaaaatggaagggccctagatcgttggcatcagcggttacctaaccgaagtggatcaaatcagcgcctatttttccgtttagaacgattagatgccgtcaatatgtatgtgcttactgtatcatccacgtagtaaagctggggcgtagcatccctaggttactttctcaatactggggtccctgaccaaagataaaacataacctattatggcgtacgagtcaaagttaaacgctatttgactcgggcagcatgcatgacccgggggaatggaaaacttctcatggctaccccaacgaagccagacaagatctaggagatgtctccaccttccgagctacactctcacatctcttacatagacactgtgaagtaagtgattgcacacaatccaaagaagcacatcaaataatatgtaaatattacccgtacaaatggcaaatcatgtccactttcccgttagtcatcgggtgggccggtcctcgcactttccttttgtttcggatgttaattaatatataaatggatctataattttcaaaaggtataaacgcacagtatgaaaaatattgcaagaataatgtgtttataaattattttttttgctggtagcaaaatcaactcattgtcttccattcagagtctaatcgaacgttatcgcaatgcttgcacacttttaaacaatacgatttagtttaagtggatggacccccacgcttagtgttccacaggtttgtccccactgtttttacattccactgtacatttttgcaatagaaggtcattgtatgctaccttgggcggctaagaatacctgtaaaaatttggagaaattagattcgtaaagaatgactcgcaacgactccaatgatttcttcttttcaccctttgaacggccgatatccgcgcgggatcctgaccccgcaatttactccactagaccggcgtgtttctctttttccttttcctggggttagagcccaagagctaatagccgacaaacggactccaaaaaaaaaaggaggcacaggacaaacgcagcacctgcgtcattcacgctgaagcggcagcaagcattttcgatcagctccaattaaatgaagactattcgccgtaccgttcccagatgggtgcgaaagtcagtgatcgaggaagttattgagcgcgcggcttgaaactatttctccatctcagagccgccaagcctaccattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtaacacttactatctcctatggtactatcctttccaaaaaaaaaaaaaaaaaaaaaaaaaataaaacaagcaaagtgaagtaccctcttgatgtataaatacattgcacatcattgttgagaaatagttttggaagttgtctagtccttctcccttagatctaaaaggaagaagagtaacagtttcaaaagtttttcctcaaagagattaaatactgctactgaaaatatgtcgtcgtcaattacagatgagaaaatatctggtgaacagcaacaacctgctggcagaaaactatactataacacaagtacatttgcagagcctcctctagtggacggagaaggtaaccctataaattatgagccggaagtttacaacccggatcacgaaaagctataccataacccatcactgcctgcacaatcaattcaggatacaagagatgatgaattgctggaaagagtttatagccaggatcaaggtgtagagtatgaggaagatgaagaggataagccaaacctaagcgctgcgtccattaaaagttatgctttaacgagatttacgtccttactgcacatccacgagttttcttgggagaatgtcaatcccatacccgaactgcgcaaaatgacatggcagaattggaactatttttttatgggttattttgcgtggttgtctgcggcttgggccttcttttgcgtttcagtatcagtcgctccattggctgaactatatgacagaccaaccaaggacatcacctgggggttgggattggtgttatttgttcgttcagcaggtgctgtcatatttggtttatggacagataagtcttccagaaagtggccgtacattacatgtttgttcttatttgtcattgcacaactctgtactccatggtgtgacacatacgagaaatttctgggcgtaaggtggataaccggtattgctatgggaggaatttacggatgtgcttctgcaacagcgattgaagatgcacctgtgaaagcacgttcgttcctatcaggtctatttttttctgcttacgctatggggttcatatttgctatcattttttacagagcctttggctactttagggatgatggctggaaaatattgttttggtttagtatttttctaccaattctactaattttctggagattgttatggcctgaaacgaaatacttcaccaaggttttgaaagcccgtaaattaatattgagtgacgcagtgaaagctaatggtggcgagcctctaccaaaagccaactttaaacaaaagatggtatccatgaagagaacagttcaaaagtactggttgttgttcgcatatttggttgttttattggtgggtccaaattacttgactcatgcttctcaagacttgttgccaaccatgctgcgtgcccaattaggcctatccaaggatgctgtcactgtcattgtagtggttaccaacatcggtgctatttgtgggggtatgatatttggacagttcatggaagttactggaagaagattaggcctattgattgcatgcacaatgggtggttgcttcacctaccctgcatttatgttgagaagcgaaaaggctatattaggtgccggtttcatgttatatttttgtgtctttggtgtctggggtatcctgcccattcaccttgcagagttggcccctgctgatgcaagggctttggttgccggtttatcttaccagctaggtaatctagcttctgcagcggcttccacgattgagacacagttagctgatagatacccattagaaagagatgcctctggtgctgtgattaaagaagattatgccaaagttatggctatcttgactggttctgttttcatcttcacatttgcttgtgtttttgttggccatgagaaattccatcgtgatttgtcctctcctgttatgaagaaatatataaaccaagtggaagaatacgaagccgatggtctttcgattagtgacattgttgaacaaaagacggaatgtgcttcagtgaagatgattgattcgaacgtctcaaagacatatgaggagcatattgagaccgtttaatcacttttcattgctctctagggcgtgttcgcttctctatgtaactgcatttcacatatattcatattatagcctttataacattacataaaagacatgatatacgacatactttaaagttagaatttttgttgtattaattttctcgaagggattagaatgtaagtacatttaaatagcgccgcaagaaacataacagccgttaacactagcaagatggtagattactgtgtctaagaatttaaattgttttgcttgcttttgccactataagacaataatagtaatagaaaagaaatgttagtcgaacagcaaattggtaaaagtggaaaaaattatttcgttattcattttaggccgttcagaaatatagcattttggttcttgcactgaatgggccctgaggacagtgtgcggctggatagccatatacttcgacattacttttcacctttgaagggggatgtatgcttatacacaatcaaagctcggcctgtgcaggtttcactacataagcttttttaccatagaaatcttgcagaaggaagtaagtatcaagatattacgtatcgcatccatagaacgatagcagaaaaatgcagtatatgataacgatatgcttcacagctgcggcccatttggggaaaaaaggaaaaggagcatcctcgatcttacagatgtcgctttttcctcttgaggtcattccctaaccttggatccaagtcaatctggtatcttcccaccctaaatagtgtattccccatgtaataagatcggacgataaacttcgaaacaattctagccttttttattagatatttactctactttagatttggtgattttactaaatgttatccttcagccactacagcctactttttctcactaatatgttcttgaagccattttcttcaccgggctttgccgaaggttatttcacgatcttcggcattcgccgaaaatttttcaagatgcccatcaccaaaaaataaaaaaagctttatatatggcatggcatacgcatcgggaaccggtattcttctcttggattacacagtttggactactagacgtttcaaatagatatacacaattactcaaaaaaaaattgaacttccgtaccaaacatgacagccagtttaactaccaagttcttgaacaatacctatgaaaacccatttatgaatgcatccggtgttcattgcatgactacacaagaattagatgaattagcaaactctaaagctggcgcattcattacaaagagtgctacaaccttagaaagagaaggtaaccctgaaccacgttacatttctgtccctctaggcagtatcaactccatgggtttaccaaacgaaggtatcgactactatttgtcctatgtattaaaccgtcaaaagaattatcctgatgcacctgctattttcttctcagttgctggtatgagcattgatgaaaatttaaatttgttgaggaaaatccaagatagcgaattcaacggtattaccgagttaaacttgtcttgtcctaatgtgcctgggaaaccacaagttgcttatgactttgacttgacaaaggaaaccttggaaaaggtttttgcctttttcaaaaaacctcttggtgtcaagttgcctccttattttgattttgcccattttgatatcatggcaaaaatattgaacgagttcccattagcttatgtcaactctatcaatagtataggaaatggtcttttcattgatgtggagaaggagagtgtagtagtgaagccaaagaatggtttcgggggtattggaggtgaatatgttaagccaaccgcgctcgccaatgttcgtgcattttacactcgtttgagacctgaaatcaaagttatcggtacaggtggaattaagtccggtaaggatgcatttgaacatcttctatgtggtgcctctatgctacagattggtacagaattacaaaaagagggcgtcaagatttttgaacgtatcgaaaaagaattaaaagacataatggaagctaagggttatacatccatagatcagttccgtgggaagttgaacagcatttaattatcggaatttgaagaactatgatgggacaagttatggaagagtgttaagattcgtatgaatattttattattttgaaattgcataaatcaaggatagttggtaaatgctaattccttaatttttcggtgagtgcattcgcaattggcatcatacattagggttcaatgtgctttaatagatgatgatactaaatacttatactttgaaataacttaatcaatgtaaattattgtcttgattcatttatacttaaatttttatatctcaacatatgatatatccttacattaagacttattcaagaaacatttttcaacgataattattagtaggctaaaaatggcataggaaccagaaaataatgttgaagaaatgaagccatctgtttaatatttggggaaaaaagtgaagaaattaacgaatatgtgcatatatatatatatatatatatatatattgcacaggtgattttgatgtagaatgtagccttttcgaaagagtaatttggttttatctacagagttccgaaacattgttaagtgcctgttcttatataattaaactgtactttctgtaaaagtcaatttgtggctggcgcatccacggtataccaatggttccgtgtaattcgatattgactaagaaccaaaaagaaatgctttaatccttgtattgtccaaatcccccaccaccaggggttttaatgatgaatcgatcaccgggttgagcgtaaatcgtatttttaccgccgacattgattaatgcgcctgtgctatgtcttacccataaattctcacctctactaccgtcttgtcctccctttataccatgagggccaatgacacgacgttctgataatatagatgctgttacagccttccgaaattgaacatcccttactacgccatttccgccagtatatttacctttgcctcctgaacctcttctgatcgagaactctttcaacagaacggggtatctcctttcaaatacctcagtatctgtcattcttgtattggtcatattcgtgtgtacagcgtctgagccattccaaccacttcctctccatgaatctgcaccagcccccgagccgccacatatggtttcataatatccaaagcctttgatctgcttatcggttttgttaccagaatttcctccagttccaaatgtaaagttgttacagtcaccttgagaatctgccatgacgttaaatgtttttaagattacatctgtcactctttgggaagttaatacattgcctccgacaacagcagcaccggatcgggggctcaagagggaaccagcaggaatttttattgttaagggttttaaacaaccttgatttaaaggaatatcttcgcctactagacaccgtagacaataaagaatcgcagaattagtaatagcctctggtgcatttaaattaccataaacttggggagaagtgccatcgaaattaaaaatatactcctctttttcaggtcttatgataacttgtagtttaattaagcttccatcatctaagcgatcttcgccagaaaacttcgttgtgccaaaatgttcaaccatttttgcaagcattttttttatggattcagatgcatttgtctgaattgcagccatgtatttcaatattgtagccagatcatattccttagttaatgacccaattaactgtatcccttttgtgttagctgcgacttgcgcttttaaatcgcttatgttatcactaaatcttcttgaacctgagcagcctgggtatttgcctggatcttctacgaaaagcttgtaaattaattcttcctggaaaattccctctttgacaaccaattcggaataaattgcggttccttcttcgtacaattctttggaatttggaggcactgaaccgggtagaatacctccaatatctgcatgatgggctcttgaagccacataaaatatcaattcgccagttgaagagaaagaaggagttattactgttatgtctggtaaatgagtaccaccaatatccggatggtttgtgattaaaacatcaccaggctttaatttgccttcccataacttcgcctgtgctgatatgcaggttgacattgatcctaagtgaacaggtacatgaggagcgttagcgactaagtttcctttagagtcgaatagtgcacatgaaaaatctaatctctctttgacgttagttgaaacagaagttttcctcaattgagtacccatctggagggcgatatccataaacctatgactgaaaatagacaataagattggatctatatcaagttcatatccgcttttagataatgtcttcgcagccttttggttgatcttgataaatatatgagagtttaaaattgttgcttggctgtttggtaaaataatatttgtttgggtaccgtcagccaatatggctgggccctcgataattgttccggcaggaagatcatcaattttgaagaccgcagtgtcgacccatttgttgtcaaaatatgctttctgggtaaaactagcatcctttgacacgtcggctttcttgaaatgggaaatttcaatcaattgctcatcaaccgttttttcttttctaacgcctgatttcccaattgctcttatccttatatcatcaattataattcgtttgtcatcgaatgagaatccgaactcttttttatgagcttcagagaaccattccctaaaattccattggtcatcatatttttgtaatatcatcaaactggtttcagtaccttcatatctgagatttaaatatctttccaagactatgtcctcccgagaaaacgactgagataaaaggtttttgattgaatttttagaaagttctaagaatctttttttcactttcaagatggtctctggctcacccaagataaaagagcaaggctcttggttttcttcaataacatctgctaagaaaatgccataagcggacaagatagaagaatatctatgaattaaaacagtgtcaatgcccaatgaatctgcaaccgctatggcgtgttgcccgccagccccgccaaaggaaactaaccgatgctgagatactacatgtccttttgcttctgtaatggccctcacaggtcttgccatgcattcgttagctactttgataaatccataggcaacctcttccatggttagatttgaattcagatccttattgatgacatctgttaattctctgaatttcaaagtagtggtttctaagtcaagtgattcatcctcattgggcccaaaaattttggggaagaactcaggaaccaaacgtcctaaaaagaggttggcgtctgtaatggtcaaaggcccgccctttctgtaggctgcagggcctggatcagcagctgctgaa

(The sequence listing continues in the following parts.)

The invention claimed is:

1. A non-naturally occurring or engineered composition comprising a CRISPR-Cas system comprising a first guide-polynucleotide and a second guide-polynucleotide and a Cas protein, wherein the first and second guide-polynucleotides are distinct from each other, and wherein each comprises a guide-polynucleotide sequence that is the reverse complement of a target-polynucleotide sequence in a host cell, which host cell is *Saccharomyces cerevisiae* or a *Kluyveromyces lactis*, wherein each guide-polynucleotide can direct binding of the Cas protein at the target-polynucleotide in the host cell to form a CRISPR-Cas complex, wherein each guide-polynucleotide sequence is the reverse complement of the (N)y part of a 5'-(N)yPAM-3' polynucleotide sequence target in the genome of the host cell, wherein y is an integer of 8-30, wherein PAM is a protospacer adjacent motif, wherein PAM is a sequence selected from the group consisting of 5'-XGG-3', 5'-XGGXG-3', 5'-XXAGAAW-3', 5'-XXXXGATT-3', 5'-XXAGAA-3', 5'-XAAAAC-3', wherein X can be any nucleotide; and W is A or T, wherein each guide-polynucleotide is encoded by a polynucleotide, and wherein the first and second polynucleotide encoding each guide-polynucleotide has sequence identity with a vector, and wherein each guide-polynucleotide-encoding polynucleotide has sequence identity with each other.

2. A composition according to claim 1, wherein the Cas protein is encoded by a polynucleotide.

3. A composition according to claim 2, wherein the polynucleotides encoding the guide-polynucleotides and the polynucleotide-encoding the Cas protein are comprised in one vector.

4. A composition according to claim 1, wherein the vector is linear.

5. A composition according to claim 2, wherein the polynucleotides encoding the guide-polynucleotides and the polynucleotides encoding the Cas protein are comprised in separate vectors.

6. A composition according to claim 5, the vector comprising the polynucleotide encoding the Cas protein is a low copy vector and the vector comprising the polynucleotides encoding the guide-polynucleotides is a high copy vector.

7. A composition according to claim 6, wherein the vectors comprise a selectable marker, optionally, wherein each vector comprises a distinct selectable marker.

8. A composition according to claim 1, further comprising one or more distinct exogenous polynucleotides that upon cleavage of the target-polynucleotide by the CRISPR-Cas complex recombines with the target-polynucleotide, resulting in a modified target-polynucleotide.

9. A composition according to claim 8, wherein at least two distinct exogenous polynucleotides are present that upon cleavage of the target-polynucleotide by the CRISPR-Cas complex recombine with the target-polynucleotides, resulting in a modified target-polynucleotide, wherein said at least two distinct exogenous polynucleotides comprise sequence identity with each other such that recombination of said distinct exogenous polynucleotides is facilitated, wherein the recombination optionally is in vivo recombination in the host cell.

10. A composition according to claim 8, wherein a further and distinct exogenous polynucleotide is present that upon cleavage of the target-polynucleotide by the CRISPR-Cas complex recombines with the target-polynucleotide, resulting in a modified target-polynucleotide, wherein an additional polynucleotide is present that has sequence identity with the exogenous and distinct polynucleotides such that recombination of the exogenous and distinct polynucleotides is facilitated, and wherein the recombination optionally is in vivo recombination in the host cell.

11. A composition according to claim 8, wherein one or more exogenous polynucleotides are operably linked to the guide-polynucleotide.

12. A composition according to claim 1, wherein at least one vector is an autonomously replicating vector.

13. A composition according to claim 1, wherein the Cas protein comprises at least one nuclear localization sequence, optionally a heterologous nuclear localization sequence.

14. A composition according to claim 1, wherein the Cas protein has activity for directing cleavage of both polynucleotide strands at the location of the target-sequence.

15. A composition according to claim 1, wherein the Cas protein comprises at least one mutation, such that the protein has altered nuclease activity compared to the corresponding wild-type Cas protein, optionally having activity to direct cleavage of a single polynucleotide strand at the location of the target-sequence.

16. A composition according to claim 1, wherein the Cas protein encoding polynucleotide is codon optimized for the host cell, optionally codon pair optimized.

17. A composition according to claim 1, wherein each guide-polynucleotide is encoded by a polynucleotide that is operably linked to an RNA polymerase II or III promoter, optionally to a human H1 RNA polymerase III promoter, a human U6 RNA polymerase III promoter, or a yeast SNR52p RNA polymerase III promoter.

18. A composition according to claim 17, wherein a polynucleotide that is operably linked to an RNA polymerase II promoter encodes a pre-guide-polynucleotide comprising the guide-polynucleotide and a self-processing ribozymes.

19. A host cell comprising a composition according to claim 1.

20. The composition of claim 1, wherein the host cell is *Saccharomyces cerevisiae*.

21. The composition of claim 1, wherein the host cell is *Kluyveromyces lactis*.

22. The composition of claim 1, wherein the *Kluyveromyces lactis* is strain NRRL Y-1140.

23. The composition of claim 1, wherein the target in the genome is an INT1 locus having the sequence set forth in SEQ ID NO: 176.

24. The composition of claim 1, wherein the target in the genome is an INT2 (INT59) locus having the sequence set forth in SEQ ID NO: 177.

25. The composition of claim 1, wherein the target in the genome is an INT3 (YPRCtau3) locus having the sequence set forth in SEQ ID NO: 178.

26. The composition of claim 1, wherein the guide-polynucleotide sequences are selected from the group consisting of SEQ ID Nos: 26, 27 and 56-59.

* * * * *